United States Patent 11,739,335 (NUCLEIC ACIDS ENCODING CRISPR-ASSOCIATED PROTEINS AND USES THEREOF) - sequence listing, part 13

SEQ ID NO: 9763 - RNA, 3802 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9764 - RNA, 3880 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9765 - RNA, 3886 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9766 - RNA, 3586 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9767 - RNA, 3997 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9768 - RNA, 4555 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9769 - RNA, 4534 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9770 - RNA, 4738 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9771 - RNA, 5521 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9772 - RNA, 3793 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9773 - RNA, 4861 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9774 - RNA, 3937 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9775 - RNA, 4798 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9776 - RNA, 3880 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9777 - RNA, 4636 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9778 - RNA, 4669 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9779 - RNA, 3802 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9780 - RNA, 3880 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9781 - RNA, 3886 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9782 - RNA, 3586 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9783 - RNA, 3997 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9784 - RNA, 4555 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9785 - RNA, 4534 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9786 - RNA, 4738 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9787 - RNA, 5521 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9788 - RNA, 3793 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9789 - RNA, 4861 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9790 - RNA, 3937 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9791 - RNA, 4798 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9792 - RNA, 3880 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9793 - RNA, 4636 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9794 - RNA, 4669 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9795 - RNA, 3802 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9796 - RNA, 3880 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9797 - RNA, 3886 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9798 - RNA, 3586 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9799 - RNA, 3997 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9800 - RNA, 4555 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9801 - RNA, 4534 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9802 - RNA, 4738 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9803 - RNA, 5521 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9804 - RNA, 3793 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9805 - RNA, 4861 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9806 - RNA, 3937 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9807 - RNA, 4798 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9808 - RNA, 3880 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9809 - RNA, 4636 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9810 - RNA, 4669 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9811 - RNA, 3802 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9812 - RNA, 3880 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9813 - RNA, 3886 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9814 - RNA, 3586 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9815 - RNA, 3997 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9816 - RNA, 4555 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9817 - RNA, 4534 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9818 - RNA, 4738 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9819 - RNA, 5521 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9820 - RNA, 3793 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9821 - RNA, 4861 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9822 - RNA, 3937 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9823 - RNA, 4798 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9824 - RNA, 3880 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9825 - RNA, 4636 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9826 - RNA, 4669 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9827 - RNA, 3802 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9828 - RNA, 3880 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9829 - RNA, 3886 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9830 - RNA, 3586 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9831 - RNA, 3997 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9832 - RNA, 4555 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9833 - RNA, 4534 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 9834 - RNA, 4521 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9835 - RNA, 5304 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9836 - RNA, 3576 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9837 - RNA, 4644 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9838 - RNA, 3720 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9839 - RNA, 4581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9840 - RNA, 3663 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9841 - RNA, 4419 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9842 - RNA, 4452 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9843 - RNA, 3585 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9844 - RNA, 3663 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9845 - RNA, 3669 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9846 - RNA, 3369 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9847 - RNA, 3780 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9848 - RNA, 4338 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9849 - RNA, 4317 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9850 - RNA, 4518 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9851 - RNA, 5301 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9852 - RNA, 3573 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9853 - RNA, 4641 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9854 - RNA, 3717 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9855 - RNA, 4578 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9856 - RNA, 3660 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9857 - RNA, 4416 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9858 - RNA, 4449 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9859 - RNA, 3582 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9860 - RNA, 3660 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9861 - RNA, 3666 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9862 - RNA, 3366 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9863 - RNA, 3777 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9864 - RNA, 4335 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9865 - RNA, 4314 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9866 - RNA, 4518 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9867 - RNA, 5301 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9868 - RNA, 3573 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9869 - RNA, 4641 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9870 - RNA, 3717 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9871 - RNA, 4578 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9872 - RNA, 3660 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9873 - RNA, 4416 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9874 - RNA, 4449 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9875 - RNA, 3582 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9876 - RNA, 3660 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9877 - RNA, 3666 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9878 - RNA, 3366 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9879 - RNA, 3777 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9880 - RNA, 4335 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9881 - RNA, 4314 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9882 - RNA, 4518 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9883 - RNA, 5301 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9884 - RNA, 3573 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9885 - RNA, 4641 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9886 - RNA, 3717 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9887 - RNA, 4578 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9888 - RNA, 3660 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9889 - RNA, 4416 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9890 - RNA, 4449 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9891 - RNA, 3582 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9892 - RNA, 3660 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9893 - RNA, 3666 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9894 - RNA, 3366 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9895 - RNA, 3777 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9896 - RNA, 4335 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9897 - RNA, 4314 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9898 - RNA, 4518 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9899 - RNA, 5301 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9900 - RNA, 3573 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9901 - RNA, 4641 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9902 - RNA, 3717 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9903 - RNA, 4578 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9904 - RNA, 3660 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9905 - RNA, 4416 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9906 - RNA, 4449 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9907 - RNA, 3582 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9908 - RNA, 3660 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9909 - RNA, 3666 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9910 - RNA, 3366 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9911 - RNA, 3777 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9912 - RNA, 4335 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9913 - RNA, 4314 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9914 - RNA, 4518 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9915 - RNA, 5301 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9916 - RNA, 3573 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9917 - RNA, 4641 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9918 - RNA, 3717 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9919 - RNA, 4578 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9920 - RNA, 3660 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9921 - RNA, 4416 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9922 - RNA, 4449 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9923 - RNA, 3582 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9924 - RNA, 3660 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9925 - RNA, 3666 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9926 - RNA, 3366 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9927 - RNA, 3777 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9928 - RNA, 4335 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9929 - RNA, 4314 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9930 - RNA, 4518 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9931 - RNA, 5301 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9932 - RNA, 3573 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9933 - RNA, 4641 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9934 - RNA, 3717 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9935 - RNA, 4578 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9936 - RNA, 3660 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9937 - RNA, 4416 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9938 - RNA, 4449 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9939 - RNA, 3582 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9940 - RNA, 3660 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9941 - RNA, 3666 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9942 - RNA, 3366 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9943 - RNA, 3777 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9944 - RNA, 4335 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9945 - RNA, 4314 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9946 - RNA, 4548 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9947 - RNA, 5331 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9948 - RNA, 3603 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9949 - RNA, 4671 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9950 - RNA, 3747 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9951 - RNA, 4608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9952 - RNA, 3690 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9953 - RNA, 4446 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9954 - RNA, 4479 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9955 - RNA, 3612 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9956 - RNA, 3690 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9957 - RNA, 3696 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9958 - RNA, 3396 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9959 - RNA, 3807 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9960 - RNA, 4365 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9961 - RNA, 4344 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9962 - RNA, 4545 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9963 - RNA, 5328 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9964 - RNA, 3600 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9965 - RNA, 4668 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9966 - RNA, 3744 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9967 - RNA, 4605 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9968 - RNA, 3687 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9969 - RNA, 4443 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9970 - RNA, 4476 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9971 - RNA, 3609 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9972 - RNA, 3687 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9973 - RNA, 3693 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9974 - RNA, 3393 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9975 - RNA, 3804 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9976 - RNA, 4362 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9977 - RNA, 4341 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9978 - RNA, 4545 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9979 - RNA, 5328 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9980 - RNA, 3600 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9981 - RNA, 4668 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9982 - RNA, 3744 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9983 - RNA, 4605 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9984 - RNA, 3687 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9985 - RNA, 4443 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9986 - RNA, 4476 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9987 - RNA, 3609 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9988 - RNA, 3687 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9989 - RNA, 3693 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9990 - RNA, 3393 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9991 - RNA, 3804 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9992 - RNA, 4362 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9993 - RNA, 4341 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9994 - RNA, 4545 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9995 - RNA, 5328 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9996 - RNA, 3600 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9997 - RNA, 4668 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9998 - RNA, 3744 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 9999 - RNA, 4605 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10000 - RNA, 3687 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10001 - RNA, 4443 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10002 - RNA, 4476 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10003 - RNA, 3609 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10004 - RNA, 3687 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10005 - RNA, 3693 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10006 - RNA, 3393 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10007 - RNA, 3804 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10008 - RNA, 4362 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10009 - RNA, 4341 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10010 - RNA, 4545 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10011 - RNA, 5328 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10012 - RNA, 3600 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10013 - RNA, 4668 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10014 - RNA, 3744 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10015 - RNA, 4605 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10016 - RNA, 3687 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10017 - RNA, 4443 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10018 - RNA, 4476 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10019 - RNA, 3609 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10020 - RNA, 3687 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10021 - RNA, 3693 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10022 - RNA, 3393 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10023 - RNA, 3804 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10024 - RNA, 4362 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10025 - RNA, 4341 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10026 - RNA, 4545 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10027 - RNA, 5328 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10028 - RNA, 3600 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10029 - RNA, 4668 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10030 - RNA, 3744 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10031 - RNA, 4605 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10032 - RNA, 3687 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10033 - RNA, 4443 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10034 - RNA, 4476 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10035 - RNA, 3609 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10036 - RNA, 3687 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10037 - RNA, 3693 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10038 - RNA, 3393 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10039 - RNA, 3804 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10040 - RNA, 4362 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10041 - RNA, 4341 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10042 - RNA, 4545 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10043 - RNA, 5328 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaagugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10044 - RNA, 3600 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10045 - RNA, 4668 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10046 - RNA, 3744 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10047 - RNA, 4605 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10048 - RNA, 3687 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10049 - RNA, 4443 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10050 - RNA, 4476 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10051 - RNA, 3609 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10052 - RNA, 3687 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10053 - RNA, 3693 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10054 - RNA, 3393 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10055 - RNA, 3804 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10056 - RNA, 4362 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10057 - RNA, 4341 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaaugauaaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 10058 - RNA, 4744 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10059 - RNA, 5527 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10060 - RNA, 3799 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10061 - RNA, 4867 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10062 - RNA, 3943 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10063 - RNA, 4804 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10064 - RNA, 3886 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10065 - RNA, 4642 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10066 - RNA, 4675 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10067 - RNA, 3808 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10068 - RNA, 3886 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10069 - RNA, 3892 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10070 - RNA, 3592 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10071 - RNA, 4003 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10072 - RNA, 4561 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10073 - RNA, 4540 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10074 - RNA, 4741 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10075 - RNA, 5524 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10076 - RNA, 3796 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10077 - RNA, 4864 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10078 - RNA, 3940 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10079 - RNA, 4801 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10080 - RNA, 3883 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10081 - RNA, 4639 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10082 - RNA, 4672 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10083 - RNA, 3805 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10084 - RNA, 3883 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10085 - RNA, 3889 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10086 - RNA, 3589 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10087 - RNA, 4000 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10088 - RNA, 4558 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10089 - RNA, 4537 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10090 - RNA, 4741 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10091 - RNA, 5524 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10092 - RNA, 3796 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10093 - RNA, 4864 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10094 - RNA, 3940 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10095 - RNA, 4801 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10096 - RNA, 3883 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10097 - RNA, 4639 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10098 - RNA, 4672 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10099 - RNA, 3805 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10100 - RNA, 3883 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10101 - RNA, 3889 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10102 - RNA, 3589 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10103 - RNA, 4000 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10104 - RNA, 4558 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10105 - RNA, 4537 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10106 - RNA, 4741 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10107 - RNA, 5524 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10108 - RNA, 3796 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10109 - RNA, 4864 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10110 - RNA, 3940 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10111 - RNA, 4801 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10112 - RNA, 3883 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10113 - RNA, 4639 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10114 - RNA, 4672 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10115 - RNA, 3805 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10116 - RNA, 3883 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10117 - RNA, 3889 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10118 - RNA, 3589 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10119 - RNA, 4000 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10120 - RNA, 4558 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10121 - RNA, 4537 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10122 - RNA, 4741 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10123 - RNA, 5524 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10124 - RNA, 3796 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10125 - RNA, 4864 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10126 - RNA, 3940 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10127 - RNA, 4801 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10128 - RNA, 3883 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10129 - RNA, 4639 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10130 - RNA, 4672 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10131 - RNA, 3805 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10132 - RNA, 3883 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10133 - RNA, 3889 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10134 - RNA, 3589 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10135 - RNA, 4000 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10136 - RNA, 4558 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10137 - RNA, 4537 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10138 - RNA, 4741 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10139 - RNA, 5524 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10140 - RNA, 3796 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10141 - RNA, 4864 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10142 - RNA, 3940 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10143 - RNA, 4801 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10144 - RNA, 3883 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10145 - RNA, 4639 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10146 - RNA, 4672 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10147 - RNA, 3805 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10148 - RNA, 3883 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10149 - RNA, 3889 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10150 - RNA, 3589 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10151 - RNA, 4000 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10152 - RNA, 4558 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10153 - RNA, 4537 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10154 - RNA, 4741 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10155 - RNA, 5524 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10156 - RNA, 3796 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10157 - RNA, 4864 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10158 - RNA, 3940 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10159 - RNA, 4801 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10160 - RNA, 3883 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10161 - RNA, 4639 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10162 - RNA, 4672 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10163 - RNA, 3805 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10164 - RNA, 3883 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10165 - RNA, 3889 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10166 - RNA, 3589 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10167 - RNA, 4000 nt, Artificial Sequence
  Cas9 variant mRNA product
gggagacccgugacccggaaguuguacggcuacgcgacuuucccucccacaaacccucgcgcccuuccuuuccuacuugggcccggcagaaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10168 - RNA, 4558 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10169 - RNA, 4537 nt, Artificial Sequence
  Cpf1 variant mRNA product
gggagacccgugacccggaaguuguacggcuacgcgacuuucccucccacaaacccucgcgcccuuccuuuccuacuugggcccggcagaaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10170 - RNA, 4479 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10171 - RNA, 5262 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10172 - RNA, 3534 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10173 - RNA, 4602 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10174 - RNA, 3678 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10175 - RNA, 4539 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10176 - RNA, 3621 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10177 - RNA, 4377 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10178 - RNA, 4410 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10179 - RNA, 3543 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10180 - RNA, 3621 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10181 - RNA, 3627 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10182 - RNA, 3327 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10183 - RNA, 3738 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10184 - RNA, 4296 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10185 - RNA, 4275 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10186 - RNA, 4476 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10187 - RNA, 5259 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10188 - RNA, 3531 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10189 - RNA, 4599 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10190 - RNA, 3675 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10191 - RNA, 4536 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10192 - RNA, 3618 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10193 - RNA, 4374 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10194 - RNA, 4407 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10195 - RNA, 3540 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10196 - RNA, 3618 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10197 - RNA, 3624 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10198 - RNA, 3324 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10199 - RNA, 3735 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10200 - RNA, 4293 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10201 - RNA, 4272 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10202 - RNA, 4476 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10203 - RNA, 5259 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10204 - RNA, 3531 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10205 - RNA, 4599 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10206 - RNA, 3675 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10207 - RNA, 4536 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10208 - RNA, 3618 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10209 - RNA, 4374 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10210 - RNA, 4407 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10211 - RNA, 3540 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10212 - RNA, 3618 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10213 - RNA, 3624 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10214 - RNA, 3324 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10215 - RNA, 3735 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10216 - RNA, 4293 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10217 - RNA, 4272 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10218 - RNA, 4476 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10219 - RNA, 5259 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10220 - RNA, 3531 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10221 - RNA, 4599 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10222 - RNA, 3675 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10223 - RNA, 4536 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10224 - RNA, 3618 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10225 - RNA, 4374 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10226 - RNA, 4407 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10227 - RNA, 3540 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10228 - RNA, 3618 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10229 - RNA, 3624 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10230 - RNA, 3324 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10231 - RNA, 3735 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10232 - RNA, 4293 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10233 - RNA, 4272 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10234 - RNA, 4476 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10235 - RNA, 5259 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10236 - RNA, 3531 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10237 - RNA, 4599 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10238 - RNA, 3675 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10239 - RNA, 4536 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10240 - RNA, 3618 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10241 - RNA, 4374 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10242 - RNA, 4407 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10243 - RNA, 3540 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10244 - RNA, 3618 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10245 - RNA, 3624 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10246 - RNA, 3324 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10247 - RNA, 3735 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10248 - RNA, 4293 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10249 - RNA, 4272 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10250 - RNA, 4476 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10251 - RNA, 5259 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10252 - RNA, 3531 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10253 - RNA, 4599 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10254 - RNA, 3675 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10255 - RNA, 4536 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10256 - RNA, 3618 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10257 - RNA, 4374 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10258 - RNA, 4407 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10259 - RNA, 3540 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10260 - RNA, 3618 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10261 - RNA, 3624 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10262 - RNA, 3324 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10263 - RNA, 3735 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10264 - RNA, 4293 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10265 - RNA, 4272 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10266 - RNA, 4476 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10267 - RNA, 5259 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10268 - RNA, 3531 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10269 - RNA, 4599 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10270 - RNA, 3675 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10271 - RNA, 4536 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10272 - RNA, 3618 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10273 - RNA, 4374 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10274 - RNA, 4407 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10275 - RNA, 3540 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10276 - RNA, 3618 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10277 - RNA, 3624 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10278 - RNA, 3324 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10279 - RNA, 3735 nt, Artificial Sequence
  Cas9 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10280 - RNA, 4293 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10281 - RNA, 4272 nt, Artificial Sequence
  Cpf1 variant mRNA product
gggagaauauaagcguuggcggagcgucgguuguagcacucugcgcgcccgcucuucugcugcuguuugucuacuuccuccugcuuccccgccgccgccgccgccaucaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10282 - RNA, 4599 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10283 - RNA, 5382 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10284 - RNA, 3654 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10285 - RNA, 4722 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10286 - RNA, 3798 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10287 - RNA, 4659 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10288 - RNA, 3741 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10289 - RNA, 4497 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10290 - RNA, 4530 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10291 - RNA, 3663 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10292 - RNA, 3741 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10293 - RNA, 3747 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10294 - RNA, 3447 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10295 - RNA, 3858 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10296 - RNA, 4416 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10297 - RNA, 4395 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10298 - RNA, 4596 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10299 - RNA, 5379 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10300 - RNA, 3651 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10301 - RNA, 4719 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10302 - RNA, 3795 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10303 - RNA, 4656 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10304 - RNA, 3738 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10305 - RNA, 4494 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10306 - RNA, 4527 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10307 - RNA, 3660 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10308 - RNA, 3738 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10309 - RNA, 3744 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10310 - RNA, 3444 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10311 - RNA, 3855 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10312 - RNA, 4413 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10313 - RNA, 4392 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10314 - RNA, 4596 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10315 - RNA, 5379 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10316 - RNA, 3651 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10317 - RNA, 4719 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10318 - RNA, 3795 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10319 - RNA, 4656 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10320 - RNA, 3738 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10321 - RNA, 4494 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10322 - RNA, 4527 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10323 - RNA, 3660 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10324 - RNA, 3738 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10325 - RNA, 3744 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10326 - RNA, 3444 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10327 - RNA, 3855 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10328 - RNA, 4413 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10329 - RNA, 4392 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10330 - RNA, 4596 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccuaaaaaaaaaaggaaaguaggaauucauggaguaccugcugccgacaaaaaguacaguauagggcuugacaucgguacaaauucuguuggaugggcugucauaacugaugaauacaaaguaccaagcaagaaauucaaaguguuaggaaacaccgacagacacagcauaaaaaaaaaccuuauaggagcccuuuuauuugacaguggcgaaacagcugaagccacaaggcuaaaaagaacagcuaggagacguuauacuagaagaaaaaacagaauaugcuaucuacaggaaauauucuccaacgaaauggcaaaaguagaugacaguuucuuccaucguuuggaagaaucauuucuagucgaagaggacaaaaaacacgaacgacauccgauauuuggaaauaucguugaugagguagcguaucacgagaaauauccaaccauauaucauuugagaaaaaaacuaguagacuccacagauaaagcggaucuacgguuaauauaccuugcacuggcccacaugauaaaguuccgcgggcacuuucuaaucgaaggagacuuaaaccccgauaauagugacgucgauaaacuauuuauacaauuaguacaaacuuauaaccagcucuuugaagaaaaccccaucaacgcuagcggcguugaugcaaaagcaauacugucagcacgucugucaaaaagccgcaggcuagagaaccucaucgcacaacuaccaggagaaaaaaaaaauggacuauucgggaacuuaaucgcacuaucacuuggccuaacacccaauuucaaaagcaauuucgaccucgccgaagacgcuaaacuacaacuauccaaagacacuuacgacgacgaucuugacaaccucuuggcacaaaucggggaccaauacgcagaucuguuuuuggcagcaaaaaaucuaucggacgcuauacuacuaucugauaucuuacgagugaauaccgagauaacuaaagccccccuuagcgcgucaaugauaaaaagauaugaugaacaccaccaggaucuuacacuauuaaaagcucuaguacgucaacagcuaccagaaaaauacaaagaaauauuuuuugaucaaucgaaaaauggauacgccggauacaucgacggaggagcuucucaagaagaauucuauaaauucauaaaaccuauccuugaaaagauggacgggacugaagaauuauuaguaaaacuaaacagagaagacuuacuaagaaaacaaagaacauucgacaacggcaguauuccucaucagauacaucugggugaauuacacgcaauucuacgaagacaggaggacuuuuauccauuccuaaaagacaacagagaaaagaucgaaaaaauacuaacauuccguaucccauauuacguugguccacuagcaagaggaaauucuagauucgcuuggaugaccagaaaaagcgaagaaacgauuacaccuuggaauuuugaagaaguaguagacaaaggggcuucagcacaaagcuuuaucgaaagaaugacaaauuuugacaaaaauuugccaaacgaaaaaguacuaccaaaacauagccuauuauaugaauacuuuacuguauacaacgaacucacuaagguaaaauacguaacggaagggaugagaaaacccgcauucuuaaguggagagcaaaaaaaagcaauugucgaccuauuauuuaaaacaaaucgaaaagucacaguaaaacaacucaaagaagauuacuuuaaaaaaauugaaugcuucgacucagucgaaauaagcggagucgaagauagguucaaugcuagccugggcacauaucacgauuuacuuaaaauaauaaaagauaaagauuucuuagauaacgaagaaaaugaagacauuuuagaggauauuguauuaacuuuaacauuauucgaagauagagagaugauugaagaaagacuaaaaacauaugcccaccuauucgacgauaaaguaaugaaacaacugaagagaaggagauauacaggauggggaagacucucaaggaaguuaauaaaugguauuagggauaaacaaaguggaaaaacgauacucgauuuucuaaaaagugauggauuugcaaaucgcaacuucaugcaauuaauucaugacgauucacuaacauucaaagaagacauacaaaaggcacaaguauccggacaaggagauucacuacacgagcacauugccaacuuagcaggaucaccagcaauuaaaaaaggcauacuacaaacggugaaaguaguugacgaauuagucaaagucauggguaggcauaaaccagaaaacauaguaaucgaaauggcaagagaaaaucaaacgacacaaaagggacaaaaaaacucgagagaaagaaugaaaaggauagaagaaggaauaaaagaacuaggaucacaaauacuuaaagaacacccuguagaaaacacucagcuucaaaacgaaaaauuauacuuguauuaccuccaaaacggucgagauauguacgucgaucaggaguuagauaucaauagauuaagcgacuaugacgucgaucauauaguaccacaaagcuuucuaaaagaugauagcauagauaauaaaguauuaacaagaagcgauaaaaaucguggaaaaucagauaaugugccaucugaagaaguaguaaagaagaugaaaaauuacuggaggcaacuacuaaacgcaaaauuaauaacucagagaaaauucgauaaccuaacuaaagccgaaagaggaggacuaagugaacuagacaaagccggauucauaaagagacaauuaguagaaacgagacaaauuacaaagcauguugcucaaaucuuagauaguaggaugaacacaaaauaugacgaaaaugacaaauugauuagagaagucaaaguaauuacacuaaaauccaaguuaguauccgacuucagaaaagauuuucaguuuuacaagguuagagaaaucaacaacuaucaucacgcccacgacgcauaucugaacgcagucguaggaacagcgcuaauaaaaaaauacccaaaacuagaaucagaauuuguauacggcgauuauaaaguguaugauguucgcaaaaugaucgcuaaaucagagcaagaaauagguaaagcuacagcgaaauacuuuuucuacaguaauauuaugaauuuuuucaaaaccgagaucacacuagcgaauggagagaucagaaaaagaccacugauugaaacaaacggagaaacaggagaaauaguuugggauaaaggcagagacuuugcaaccguaagaaaaguacuaaguaugccacaaguaaauaucguaaaaaaaacagaaguacaaacagguggguuuucuaaagaaagcauacuaccaaaacguaauucagauaaacuaauagcucgaaaaaaagauugggaucccaaaaaauacggaggauuugacucuccaacggucgccuauucugucuuaguaguagcgaaaguagaaaaaggaaaaaguaaaaaauuaaaauccguaaaagaauugcucgguauaacaaucauggagagaucuagcuucgaaaaaaaucccauagauuuccuagaggcaaagggguacaaagaaguaaaaaaagaucucauaauuaaauuaccuaaauacucuuuauuugaauuagaaaacgguagaaaaagaauguuagcaucagcaggagaauugcaaaaagguaaugaacuggcacuacccucuaaauauguaaauuucuuauauuuagcaagccacuaugaaaaacuaaaagguucuccagaagauaacgaacaaaaacaacuguucgucgaacagcacaaacacuauuuagacgaaauaauugaacaaauaucggaguucucuaaaagaguaauacuggcagaugcaaauuuagacaagguacuaucagccuacaauaaacacagagauaaaccaauacgugaacaagcggaaaacaucauacaucucuuuacccucacaaaucuaggagcaccugcagcauuuaaauacuuugauacaacaauugauagaaaaagguauacgagcaccaaagaagugcuagacgcgacacuaauccaccaaucaauaaccggccuauaugaaaccagaauagaucuaagucaauuaggaggggacaaaagaccagcagcuacaaaaaaagcaggccaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10331 - RNA, 5379 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggccccuaaaaaaaaaagaaaaguggguauccauggaguacccgccgcaaacuucaaaauauuaccaaucgcaauagaucuuggcguaaaaaacacagggguauucucagcguuuuaucagaagggaaccagucuagaaagauuagacaauaaaaaugguaagguauacgaacuuucaaaagauucuuacaccuuacucaugaauaaccgaacagcaagacggcaccaaagaagaggaauugaccgaaaacaguuaguaaaacgacuuuucaaacugauauggacagaacaacuaaaucucgaaugggauaaagauacccagcaggcuauaucauucuuauucaaucgccgcggauuuucauuuauuacagacgguuacucgcccgaauaucuaaauauaguacccgaacaaguaaaagcgauauugauggauauauuugacgauuauaacggcgaagaugaccuugauucauaccuaaaacucgcaacagaacaagaaaguaagauaagugaaauauauaacaaacugaugcaaaaaauauuagaauuuaaacuaaugaaacuaugcacagauauuaaggaugacaaaguaucaacuaaaacuuuaaaagaaauuacuagcuacgaauucgaacuacuugcagauuaccuagcgaacuacucagaauccuuaaagacucaaaaauuuuccuacaccgacaaacaagguaaucuaaaagaacugucauacuaccaucacgauaaauacaacauacaggaguuccuuaagcggcacgcuaccauuaacgaucgaauucuugacacacuacuaacugacgaucuagacaucuggaauuuuaacuuugagaaauuugacuuugacaaaaaugaagaaaaauuacaaaaucaagaagauaaggaucacauccaagcccauuugcaccauuucguauucgcuguuaacaaaauaaaguccgaaauggcaucaggcgggcgccaucgaucccaauacuuccaagagauaacaaauguucuugaugagaacaaccaucaagaaggcuaccuuaaaaacuucugugaaaaucuucauaauaagaaauauucaaacuuaucagucaaaaaucuugucaaucuaauaggaaacuuaucaaacuuggaacucaaaccacuccguaaguauuucaacgauaaaauacaugcaaaggcugaucauugggacgaacaaaaauucacagagaccuacugucacuggauauuaggcgaauggaggguaggaguuaaagaucaagacaaaaaagauggagcaaaauacucauauaaggaccuuuguaacgaacuaaaacaaaaaguaacuaaagcgggacucguagacuuccuacuagaacuugaucccugcagaacuauaccgccuuacuuagacaacaauaaccgaaaaccaccaaagugccagucacuaauacucaaccccaaauuucuagacaaucaguaccccaauuggcaacaauaccuacaagaauugaaaaaacuucaauccauucaaaacuaucuagacaguuuugaaacugaucuaaaaguccuaaaauccuccaaggaccaaccauacuucguagaauauaaaucaagcaaccaacaaauagccaguggucagcgagacuauaaagauuuagaugcacgcauccuacaauuuauauucgauaggguuaaagcuagcgacgaauuauuacugaaugaaauauacuuccaagcgaaaaaacuuaaacaaaaagcgucaucugaacuagagaaacuugaaucaucaaaaaagcuagacgaaguaauagcaaacagucaacuuucacaaauacucaaaucacaacauaccaauggaaucuucgaacaaggaacauuucuacaccuuguguguaaauacuauaaacaaaggcaacgcgcacgagauucacgauuauacauaaugccggaauauagauacgauaaaaaauuacacaaauacaacaauacuggaagauucgacgacgauaaccaacuccuaacauacuguaaccacaaaccaagacaaaaaagauaccaauuacuuaaugaccuagcaggcgucuuacaaguaucaccuaacuuccuaaaagauaaaauuggaucagacgacgaccucuucauaagcaaauggcuagucgaacacauaagaggauucaaaaaagcaugcgaagauucccucaaaauccaaaaagauaauagaggucuucucaaccauaaaauaaauauagccagaaacacaaaaggaaaaugugaaaaagaaauauuuaauuuaauuugcaaaauugaagggucugaagauaaaaaaggcaacuacaaacauggccuagccuaugaacucggcguauuacuauucggugaaccuaacgaagcaucaaaaccugaauucgaucguaagauaaagaaauucaauucaauauacucuuuugcccaaauccaacaaauagcauucgccgaaagaaaaggaaaugcaaauaccugcgcaguaugcagugcugacaacgcacaccguaugcagcaaauaaagauaacagaacccguggaagacaauaaagauaaaauaauacucagugcgaaagcccaaagacuaccagccauacccacccguauuguagauggagcaguaaaaaaaauggcaaccauccuagcuaaaaacauugucgacgauaacuggcaaaacaucaaacaaguauuauccgcaaaacaucaauuacauauacccaucauaaccgaaucaaacgcauuugaguucgaacccgcccuugcagacgugaaaggaaaaucccucaaagacagacgaaaaaaagcccuagaaagaauaucaccggaaaauaucuuuaaggacaaaaacaaccguaucaaagaguuugcgaaaggaauaucagcauacucgggagcaaaccucaccgauggagauuucgacggcgcaaaagaagaauuggaccauauaauuccaagaucccauaaaaaguacgggacccuuaaugaugaggcgaauuuaauaugcguaacacggggugacaacaaaaacaaaggaaauagaaucuuuuguuuaagagaucucgcggacaauuacaaacuaaaacaauucgaaacaacagaugaccuagaaauagaaaaaaaaaucgcugauacaauaugggacgcuaauaaaaaagacuuuaaauuuggaaauuauaggucauuuaucaacuuaacgccacaggaacaaaaggcauucagacaugcguuguuuuuagcagaugagaacccuauaaaacaagcaguaauuagagccauaaauaacagaaaccgaacauucgucaacggcacucaacgauacuuugccgaaguuuuagccaacaacauauaccugcgagcaaaaaaagaaaauuuaaauacagauaagauaucauucgacuauuucgggaucccaaccauugguaauggaagaggaauagccgagaucagacaauuauacgaaaaagucgauagugacauacaagcauaugcaaaaggcgacaaaccacaagcaucauauucucacuugaucgacgcuaugcuagcauuuuguauugccgcagacgaacaucgaaacgauggcucaaucggacuagagaucgauaaaaauuacucccuauauccacuagacaaaaacacaggagaagucuuuacaaaggauauauuuagccaaauuaaaauuacggacaaugaauucagugacaaaaagcuuguuagaaaaaaagcaaucgaaggauuuaacacacaccgacaaaugacaagagauggaauauacgcagaaaacuaucugccuauacuuauucacaaagaacugaaugaaguaagaaaggguuacacauggaaaaauucagaagaaauaaaaauauuuaaaggaaaaaaauaugacauccaacaacuuaacaauuuagucuauugcuuaaaauuuguagauaaaccuauaucuaucgauauucaaauaagcacacuugaagaauuaagaaauauacuuacaacgaacaauauagcggcaacagcagaguauuacuauauaaaccuaaagacacaaaaauuacaugaauacuacaucgaaaacuacaacaccgcucucggauauaaaaaauacaguaaagaaauggaauuccuuaggaguuuagccuacaggucugaaagaguaaaaauaaaaagcauagacgacguuaaacaaguacucgauaaagacucaaauuuuaucaucggcaaaauaacacuucccuuuaaaaaggaguggcagagacucuaccgagaauggcaaaacaccaccauaaaagacgacuacgaauuucucaaaucguuuuucaaugugaaaucaauaacaaaacuacacaaaaaagugcggaaagacuucucacuaccaauaucaacaaacgaggguaaauuccuagucaaaagaaaaacuugggacaacaauuuuauuuaccaaauucuuaacgauucagacaguagagcggauggaacgaaaccauucauuccagcauucgacauaucaaaaaaugagauaguugaagcaauaauagauucauuuacuucuaaaaauauauuuuggcucccaaaaaauaucgaacuacaaaaaguagacaacaaaaacauauuugcaauagauacauccaaaugguuugagguugagacacccagugaccuacgugauaucggaauagcuaccauccaauauaaaauagauaacaacagccguccaaaaguacguguaaaguuagacuauguuaucgacgacgacagcaaaauaaacuacuucaugaaucauagcuuacuaaaaaguagauaucccgacaagguuuuagaaauacuuaagcaaucaaccauuauagaauucgaaaguucggguuucaacaaaaccauaaaagaaaugcuuggaaugaaacucgcuggaauauauaacgaaacaaguaacaauaaaagaccagcagcaaccaaaaaagcaggacaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10332 - RNA, 3651 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccaaaaaaaaaacggaaaguaggaauccacggcgucccugccgcaaaaagaaauuacauacucggacuagacauaggcauaacaucaguaggauacgguauaauagacuacgaaacgcgagauguaauagacgccggagugagacuauuuaaggaagcaaauguagagaacaacgaaggacgaagaaguaaaagaggugcacgcagacucaaacgacgucgaagacaccgaauacaacgaguaaaaaaacucuuauucgauuacaaucugcucacagaucacucugaauuaucaggaauaaacccauaugaagcaaggguaaaaggccuaagucaaaaacucucagaagaagaauuuuccgccgcucuccuacacuuagccaaacgaagagguguacacaacguaaaugagguagaagaagacacaggaaacgaacuaucuacaaaagaacaaauaucacguaacagcaaagcauuagaagaaaaauacguagcggaacuacaacuagaacgacuuaaaaaagacggcgaaguaagaggguccauaaacagauuuaaaacaagugauuacguaaaagaagcgaaacaacuccugaaaguacaaaaagcauaucaccaacucgaucaaagcuucaucgauacauauauagauuuauuagaaacccgacgaacuuacuaugaaggaccgggagaggggucaccauuuggcuggaaagauaucaaagaaugguacgaaaugcuaaugggucacuguacauacuucccggaagaacuucgauccguaaaauaugcauacaacgcagaccuuuauaacgcauuaaacgaccucaauaauuugguaauaacacgagacgaaaaugagaagcuugaauacuaugaaaaauuucaaauaauagaaaacguauucaaacaaaaaaaaaaaccaacacuaaaacaaauagccaaagaaauauuagucaacgaagaagacauaaaaggguauagaguaacaucgacagguaaaccagaauuuaccaaccuaaagguuuaccacgauauaaaagauauaacagccagaaaggaaauaauagaaaaugcagagcuacucgaccaaauagcaaaaauacuaacaauauaucagagcagcgaagacauacaggaagaauuaacaaaccuuaacuccgaauuaacacaagaagagauagaacaaauaucaaacuuaaaaggauauacaggaacucacaaccuaagcuuaaaagcaauaaaccucauauuagacgagcuuuggcacacaaaugauaaucaaaucgcaauauucaacagacuaaagcuaguuccaaaaaaaguagaccucucacaacaaaaagaaaucccgacaaccuuaguagacgacuuuauccuaucaccaguaguuaaaagaagcuuuauucaaucaauuaaggucauuaaugcuaucauaaaaaaguauggacuaccaaaugacaucauaaucgaacuagcaagagaaaagaacagcaaggacgcccaaaagaugauaaacgaaaugcaaaagcgcaauagacaaaccaacgaaagaauugaagaaauaauaagaacaacagguaaagaaaacgcuaaauaucucauagaaaaaauaaaacuacacgacaugcaagaagguaaauguuuauauaguuuggaggcgauaccauuggaagaccuacuaaacaacccauuuaauuacgaaguagaccauaucauaccaagaucuguaaguuucgauaauucguuuaacaacaaaguucuaguuaaacaagaagagaauucaaaaaagggaaaucguacaccuuuucaguaucucucaucauccgacaguaaaauaucauaugaaaccuucaaaaagcacauacuuaaccuagcaaaaggaaaaggaagaauaucaaaaacaaaaaaggaauauuugcuagaagagcgagacaucaauagauuuucaguacaaaaagacuuuauuaauagaaacuuaguagauacuagauacgccacaaggggacuaaugaauuuacuaagaucguauuucagaguaaacaaccuagauguaaaagugaaaucaauaaacggcggauucacuucuuuccuaagaagaaaauggaaauuuaaaaaagaaaggaacaaaggauacaaacaccaugcggaagacgcccuaauuauagcaaacgcugauuuuauauucaaagaauggaaaaaauuagauaaagcaaagaaagucauggaaaaccaaauguucgaagaaaaacaggcugaaucaaugcccgaaauagagaccgagcaagaauauaaagaaauauucauuaccccacaucagauuaaacauauaaaagauuucaaagacuacaaauacucacauaggguugacaaaaaacccaaucgagaacuaaucaacgacacacuguacagcacucgaaaagacgauaaaggcaacacucuaaucguaaacaauuuaaacggauuauaugacaaagacaaugacaaacuuaaaaaauuaauaaauaaaucaccugaaaaacuucuaauguaccaccacgauccacagaccuaccaaaaauuaaaacucaucauggaacaauacggugaugagaaaaauccauuauauaaauauuacgaagaaaccgggaauuaccucaccaaauauaguaaaaaagauaacggaccuguaaucaaaaaaauaaaauacuauggaaauaaacugaacgcccacuuagacauaacugaugacuaccccaauagcagaaauaaaguaguaaaacuuucacuuaaaccauaccgauucgacgucuaucucgauaauggcguauauaaauucguaacagugaaaaaccuugacguaauaaaaaaagaaaauuacuacgaaguaaacaguaaaugcuaugaagaagccaaaaagcuaaaaaaaauaucuaaccaggcagaauucauugcuagcuucuacaauaacgaccucauaaaaauuaacggagaacuauauagaguaaucggagucaauaacgaccuacuaaauagaauagaagucaauaugauugacauuacauauagagaauacuuagaaaauaugaaugauaaaagaccaccacggauaauaaaaaccauagcuucaaaaacacaauccauaaaaaaauacucuacagacauuuuaggaaauuuauaugagguaaaaagcaaaaaacacccucaaaucauaaaaaaaggaaaaagaccagcugcaacaaaaaaagcuggucaagccaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10333 - RNA, 4719 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcgcccaagaagaaacgcaaaguaggaauccauggaguaccagccgcauuauuuaacaaaugcaucauaauuuccauuaaccuagauuucucaaacaaagagaaauguaugaccaaacccuacaguauuggacuagauaucggcacuaacagcguaggaugggcugugauaacagacaauuacaaaguaccaucgaaaaaaaugaagguuuuaggaaauaccucaaaaaaguacaucaaaaagaauuuacuuggcgucuuauuauucgacucaggaauaaccgcugaaggaagacggcucaaaagaacggcaagacgaagauacacacgccgcagaaaccgaauauuguaccuucaagagauuuucucaacugaaauggcgacauuggacgacgcguucuuucaaagguuagacgauucauuucuaguuccagaugacaaacgagacucaaaauauccuaucuuuggaaaucuggucgaagaaaaaguuuaucacgaugaguuuccuacaauauaccacuuaagaaaauauuuagcagacaguacaaaaaaagcagaccuaagacuaguuuaccucgcauuagcacacaugauaaaauaccgaggccacuuucugauagaaggagaauucaauaguaagaauaacgauauucaaaaaaauuuccaagauuuucuagacaccuauaaugcuaucuucgaaagcgaucucagccuugaaaauucaaagcaguuagaagaaauaguaaaggauaaaauaucaaaguuagaaaagaaagaucgaauuuuaaaacuauucccaggagaaaaaaauucuggaauauucagcgaauuuuuaaaauuaauuguaggaaaucaagccgacuuuagaaaauguuucaaucuugacgagaaagcaagccuacacuucucaaaagagucauaugaugaagaucucgaaacacugcuaggauacauaggcgacgauuauucagauguuuuucuuaaggcaaaaaaacuauaugaugcaauacuucuauccgguuuccucacagugacagacaaugaaaccgaggcgccacuuucauccgcuaugauaaaaagguauaaugaacauaaagaagacuuagcacuuuuaaaagaauauauacggaauauaucacuuaaaaccuacaacgaaguuuuuaaagaugauacaaaaaacggcuacgcaggcuacaucgacggcaaaaccaaucaagaagacuuuuacguauacuuaaagaaccugcuggcagaauuugaaggagcugacuacuuucuagaaaaaaucgacagagaggauuuccuacgaaaacaaagaacguucgauaacgguucaauaccguaucaaauacaccuacaagagaugcgagcuaucuuagauaaacaagccaaauuuuauccuuuuuuggccaaaaacaaagaaagaauagaaaaaaucuugacauuuagaaucccuuacuauguuggaccucuugcaagaggcaacagcgauuucgcauggaguauucguaagcgaaacgaaaaaauuacuccuuggaacuuugaagaugucauagauaaggaguccagugcugaagcguuuauuaaucgaaugacuagcuuugaccuauaccuaccagaagaaaaaguacuaccaaaacauucccuacuuuacgaaacauuuaacguauacaaugaacugacaaaaguaagauucauugccgaaaguaugagagauuaccaauuccucgacaguaaacaaaaaaaagacauaguacgauuauacuuuaaagacaagagaaaaguaacggacaaagauauaauagaauaucuacacgcaauauacggauacgaugguauagaacuuaaaggaauugaaaaacaguuuaacucaagccuauccacguaucacgaccuccuaaacauaauaaaugacaaagaauuucuagacgacucaucgaaugaagcaauaauugaagaaaucauccauacucuaacgaucuucgaagacagggaaaugauuaaacaacguuuaucuaaauuugagaacauauucgauaaaagcguacuaaaaaagcuaagccgccgccauuacacgggcugggguaagcuaagcgccaaauuaauaaacgggauaagagacgaaaaaaguggcaacacuauacucgauuaccucaucgaugauggaauuucgaacaggaacuucaugcaauuaauacacgaugaugcucuuucauucaaaaagaaaauacaaaaagcccaaaucauaggagaugaagacaaaggcaacauuaaagaaguugucaaauccuuaccaggaucaccggccauaaaaaaaggaauauuacaaucgaucaaaauaguugaugaacuuguuaaaguaauggguggacgcaaaccagaaagcauagucguagaaauggcacgcgaaaaccaauacaccaaucaaggaaaaucuaauucacaacaacgcuuaaaaagacuagagaaaucauuaaaggaacucgguucuaaaaucuuaaaggagaauauaccagcaaaacuaucaaaaauagacaacaaugcguuacagaacgaucgguuauaccucuacuaucuacaaaaugggaaagacauguacaccggugaugaucuagacauagauagacuaagcaauuacgacauagaucacauaauaccacaagcauuccuuaaggacaacuccauagauaacaaagucuuaguaaguucagcaucaaacagaggcaaaagugaugacuucccaucacucgaaguagugaaaaaaagaaaaacauucugguaccaacuccuaaaaucuaaauugauuucacaaagaaaauuugacaaucucacgaaagcagagcguggaggauuacuccccgaggacaaagcaggauuuauacaaagacaacucguggaaacuaggcaaauaacaaaacauguagcuagacuauuggacgaaaaauuuaacaauaaaaaagaugaaaacaauagggcaguccguacuguuaagauuauaacacuaaaauccacacucguaucucaauuuagaaaagauuuugagcuauauaaaguccgcgaaauaaacgauuuccaccacgcacaugacgcauaccucaacgcggucauagcgucagcacuguuaaagaaauauccuaaacucgaaccagaauucguguacggugacuauccgaaauauaacagcuuucgcgaaagaaaaucagcaacagaaaaaguauacuucuacuccaacauaaugaacaucuuuaaaaaauccauaagucucgcggacgguagaguaaucgaaagaccacucauagaaguaaaugaagagacaggagaaucaguuuggaacaaagaaucggaccuagcaacaguaaggcgaguacucuccuacccccaagugaauguggucaaaaaaguagaagaacaaaaucacggccuagacagaggaaaaccaaaaggacuauuuaacgcaaaccuuucaaguaaaccaaaaccgaacuccaaugagaacuuagugggcgccaaagaguaucuagacccgaagaaauauggcggcuaugccggaaucaguaacaguuucgcaguacuaguaaaaggcacuaucgaaaaaggagccaaaaagaaaaucaccaacguacuugaauuccaagggauuagcauacuagauagaaucaauuaucgaaaagacaaguuaaauuuucuccuugaaaaaggauacaaagacauagaacuuauaauagaacuacccaaauacucacucuucgaauuaagugaugggucccgcagaauguuagccaguauucuaagcacaaacaauaaaagaggggagauacauaaagguaaucaaauuuuuuuaucgcaaaaauuuguaaaauuacuauaccacgcaaaaagaaucucaaacacaauaaaugagaaucaccgaaaauacguagaaaaccauaaaaaagaauucgaggaacuauucuacuauaucuuagaauucaacgaaaauuauguaggagcaaaaaaaaacggaaaauuacuaaauuccgcauuucaauccuggcagaaucauaguauagacgaacuauguucaucguucauuggaccuaccgguagugaacgaaaaggauuauucgaacucacuuccagagggucagcagcagauuucgaauucuuaggggucaaaauaccacgauaccgagacuacacaccuagcucacuacucaaagaugcuacccucauacaucaaucaguaaccggacucuaugaaacaagaauagaccuagcaaaauuaggugaagguaaaaggccagcugcaacaaaaaaagcuggacaagcgaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10334 - RNA, 3795 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccgaaaaagaaaagaaaaguuggaauccaugguguuccagcagcaugguaugcaucuuuaaugucugcacaccaucuaagaguuggaauugauguaggaacucauaguguuggcuuggcaacgcuaagaguagaugaucacggaaccccaauagaacuacuauccgcgcuaucccauauucaugauucaggagugggaaaagagggcaagaaagaucaugauacacgaaagaaacugucaggaauugcaagacgagcaagaagauuacuacaucacaggagaacccaacuacagcaauuagaugaaguacuccgagauuuaggauuuccaauuccaacaccaggagaauuucucgaccuaaaugaacaaaccgacccauauagaguauggagaguaagagcacguuuaguagaagaaaaguugccagaagaacuacgagggcccgcaaucaguauggcuguuaggcauauagcacggcaucgcggauggcguaacccauacaguaagguagaaucauuguuaagccccgcagaagaaagcccauucaugaaagcgcuaagagaacgaauuuuagcaacaacuggggaaguauuagaugaugggauuacuccuggacaagcaauggcucaaguugccuuaacgcauaauauaucaaugaggggaccagaaggaauauugggcaaacuacaucaaucugacaacgcuaacgaaauuagaaaaauaugcgcaagacaaggagucaguccagauguuuguaaacaacuauuaagagcaguguuuaaggcagacaguccaagagggucagcgguaagcaggguagcuccugacccacuaccgggacagggaucauuuaggagagcaccaaaaugcgacccugaauuucaaagauuuagaauaauaucaauuguggcuaaucucagaauaucagaaacaaaaggagaaaauagaccacuaacagcagacgaaagaagacacguuguaacauuucuuacugaagauagucaagcagaucuaacaugggucgaugucgcagaaaaacuaggaguacauaggagggaucuaagaggaacagcaguacacacagaugauggugagagaucagccgcaagaccaccaauagacgcuacugaucgaauaaugagacaaacgaaaauuucaucguuaaaaacauggugggaagaggcggauuccgaacaaagaggugcaaugaucagauacuuauaugaagacccgacggacucagaaugugcugagauaauugcggaacuaccagaagaagaccaagcaaaacuagacagucuacauuuaccugcaggcagagcagccuacaguagagaaagucuaacagcauuaagugaucauauguuagcaacaacagacgaucuucaugaggcuagaaaaagguuauuuggaguugaugauucaugggcuccuccugcagaagcuauuaaugcucccguaggaaacccgucuguggacaggacacuaaaaauaguagggagauaucucucagcaguugaaucuaugugggggacuccagaaguaauucauguugaacauguuagagauggcuuuacaagugagcggauggcugaugaaagagauaaagcaaaucgaagaagauauaacgacaaucaggaagcaaugaagaaaauccaaagagacuauggcaaagaaggauauauaagcagaggagauauuguaagauuagaugcucuagaauuacagggcugcgcaugucuuuauugugggacaacgauuggcuaucauacaugccagcuagaucacauaguaccacaagcaggcccuggaucuaauaaucguagagguaauuuaguagccgugugugaaagauguaaucguagcaaaucaaauacgccuuucgcaguuugggcucaaaaauguggaaucccacacguaggaguaaaagaagcaauaggaagaguacgggguuggagaaaacaaacaccaaauacuucauccgaagauuuaaccaggcuaaagaaagaaguuauagcaagacuucgaaggacacaagaagauccagaaauugaugaaagaucgauggagaguguagccuggauggccaacgaacuacaccauaggauagcggcugcauacccagaaacuacaguaaugguuuaccgggggagcauuacagccgcugcucgaaaagcagcagguauugauagcaggauuaaccuuauaggugaaaaaggaaggaaagacagaauagauagaaggcaucaugcaguagaugcaaguguaguggcucuaauggaagcaucaguagcgaaaacacuagcagaaaggucaucauuaagaggagaacaaagacugacuggaaaagagcaaacauggaaacaauacacaggaaguacaguaggcgcacgagaacauuucgaaauguggcgaggccacauguugcauuuaacagaauuauucaaugaaagguuagcagaagauaaaguauacguaacacaaaacauaagauuaagacuaagugauggaaacgcccacacuguuaauccaucaaaauuaguuagccauagacuaggugauggauugacaguacaacaaaucgaccgagcuuguacgccagcucuauggugcgcauugacuagagagaaagacuucgaugagaaaaauggauuaccugcacgagaagauagggccauaaggguacacggacaugaaauaaaaaguucggauuacauacaaguauuuucaaaacggaaaaagacagauucggaccgagaugaaacaccauuuggagcgauugcgguaagagguggauuuguugagauaggaccaaguauucaucaugcgcgaauauauaggguagaaggaaagaaaccagucuacgcaaugcuuagaguuuucacacaugaucuacugucacaaagacauggagaccuauucagugcaguaauaccaccucagaguauaaguaugagaugugcagaacccaaauuaagaaaagcaauuacaacagguaacgcaacguaccuuggcugggugguaguuggagaugaauuagaaauaaacguagauucauuuaccaaauacgccauaggaagguuucuagaagauuuccccaauacaacgagauggcgaauauguggcuacgauacaaacuccaaacuuacacuaaaaccaauuguauuagcagcagaaggcuuagaaaauccuucaagugcgguaaacgaaaucguagaauuaaaaggauggaggguagcuaucaacguacuaacaaaaguccacccuacaguugugcguagggaugcauuaggcagaccuagauacucaagucgcagcaaucuuccuacuucauggacuauugagaaaagaccagcagcuacuaagaaagccggacaagcaaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10335 - RNA, 4656 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggccccaaaaaaaaaaagaaagguagguauucacggcguaccggcugcuacaaaaccauacucaauaggcuuagacauagguacgaacaguguaggcugggcaguaacaacagacaauuacaaaguacccagcaagaaaaugaaaguccuaggcaacacaaguaaaaaauacaucaagaaaaaccuacucggaguauuauuauucgacagcggcaucaccgcagaaggacguagacuaaaaaggacagcuagaagaagauacacaaggcgacgaaaccguauauuauaucuucaagaaauauuuucaacagaaauggcaacauuagaugaugcguuuuuucaaagacuagaugacagcuuucuagucccagacgauaaacgugacuccaaauacccaauuuucggaaaccuaguagaggaaaaggcauaucaugacgaauucccaacuauauaccauuuacgcaaauaccuagcugauucaacaaaaaaagccgacuuacgauuaguuuacuuagcauuagcccauaugauuaaauauagaggacauuuucuaauugaaggagaauuuaacucaaaaaauaaugacauacagaaaaacuuccaagacuuucucgacacauacaacgcaauauuugaguccgauuuaagccuggaaaacucaaaacaauuagaagaaaucguaaaagacaaaauaucuaaacuugaaaaaaaagaccgaauacuaaaacuauuuccuggagaaaaaaauucaggaauuuucucugaauucuuaaaauuaauaguaggaaaucaagcugauuucagaaagugcuucaaccuagacgagaaagcaagcuuacacuuuucaaaagaaaguuaugacgaagaucuggaaacauuacuaggauacauuggugaugauuacagugacguauuccuaaaagcgaaaaaauuauaugacgcuauacuacugagcggguucuuaacaguuacagacaacgagacagaagcaccacugaguagugcaaugauaaaaagauauaacgaacacaaagaagaccuagcacuguuaaaagaauacauaagaaauauuucauuaaagacuuauaacgaaguguucaaagacgauacaaaaaauggauacgcgggauacauagacggcaaaaccaaccaagaagauuuuuaugucuauuuaaaaaaguuauuagcagaauuugagggagcagacuacuuccuagaaaaaaucgaucgggaagacuuuuuaagaaaacaaagaacauucgacaauggcucaaucccguaucaaauccaccuccaagaaaugagagcgauauuagauaaacaagcaaaauuuuauccauuucuagcgaagaacaaagaacgaaucgaaaaaauauuaacauuucgcauaccauacuauguugguccacuagcuagggguaacucagauuuugcauggagcauaagaaaacgaaaugaaaaaauaacaccuuggaacuucgaagauguaauagacaaagaaaguagcgcagaagcauuuauuaaucgaaugacuagcuuugaucuauauuugccagaagaaaagguguugccaaaacauagcuuacuuuacgaaacuuuuaacguauacaacgaacuaaccaaaguaagauucauagccgaaagcaugcgugauuaccaauuccuggacucgaaacagaaaaaggauauaguaagacucuacuuuaaagacaaacguaaaguuacugauaaagauauaauagaguaucuacaugcaauauauggauaugacgggauugaacuaaaaggcauagaaaaacaauuuaacaguucacugucuacauaccaugaucuauuaaacaucauaaacgauaaagaauuccuggaugauagcuccaacgaagccauaauagaagaaauaauccacacucuuacaaucuuugaggauagagaaaugauaaaacaacgucuaucgaaauuugaaaauauauucgacaaaagcguacuaaaaaaauuaucuagacgacacuauacgggcuggggaaagcuaucagccaaacuaauaaauggcauaagggacgaaaaaaguggaaauacgauacuugacuacuuaaucgacgauggaaucagcaacagaaacuuuaugcaauuaauucaugaugaugcccuaagcuuuaagaaaaaaauacagaaagcacaaaucaucggugaugaagauaaaggcaauauaaaggaaguaguaaaaucauuaccaggaagcccggcaauaaaaaaaggaauucuacaaaguauaaaaauaguagaugaauuaguuaaaguaaugggaggaagaaaaccagaaucaaucguaguugaaauggccagagaaaaucaauacacaaaccagggaaaauccaauucccaacaaagacuaaaacgacucgaaaaaucccuaaaagaacuuggcucaaaaauacucaaagaaaacauacccgcuaaacuaucaaaaaucgacaauaacgcauuacagaacgacagauuauaucuauacuacuugcagaacggcaaagauauguacacuggugacgaccuagacaucgaccgucuaucuaauuacgacauagaucacauuauuccccaagcauuccuaaaagauaauucuaucgauaauaaaguacuaguauccagugccaguaaccgugguaaaucagaugauguuccaagcuuagaaguaguaaagaaaaggaaaaccuucugguaucaacuauuaaaaucaaaacuaauaagccaaagaaaguuugacaaucuaacuaaagcagaaaggggaggauuauccccugaagacaaagcgggauuuauacaacgucaauuaguagaaacaagacaaauaacuaaacacgucgcacgcuugcuagaugaaaaauuuaauaauaaaaaagaugaaaacaacagagccguacguacagugaaaauaauaacccuaaaaagcacacuagugagucaauuccgaaaagauuuugagcuauacaaagugagagaaaucaaugacuuucaccaugcgcaugaugcuuauuuaaacgcuguuguagcuuccgcguuguuaaaaaaguauccaaaacuagaacccgaauucguguacggagacuaucccaaauacaacucguuucgagaaagaaaaucagcgacggaaaaaguuuauuucuacaguaauaucaugaauauauuuaaaaaaaguauaucauuagcagacggaagaguuauugaaagaccccuaauagaagucaacgaagaaacaggagaaucuguuuggaacaaagaauccgacuuggcuacgguuagacgaguccugucuuacccccagguaaacguaguaaagaaaguagaggaacaaaaccauggauuagaccguggcaaaccaaagggccuguuuaacgcaaauuuaagcucuaaaccaaaaccaaacagcaacgaaaaccuagugggagccaaggaauaucuagauccuaaaaaauacggagguuaugcuggaauuucuaauuccuuuacaguacucgucaaaggaaccaucgaaaaaggagcaaaaaaaaaaauaacgaacguccuagaauuccaaggaauaucuauauuagaucgaauaaauuauagaaaagacaaacucaacuuccuucuagaaaaaggguauaaagauauagaacuaauaauugaauuaccaaaauacuccuuauuugagcuuagugauggcucaagaagaauguuagcaagcauucucucaacaaacaauaaaagaggagagauucauaaaggaaaccaaauauuucucagucaaaaauuugucaaauuacuauaucaugcaaaacgaaucuccaacacaaucaacgaaaaucaucgaaaauauguggagaaccacaaaaaagaguucgaagaauuauuuuacuacauucuagaguucaaugaaaacuacguaggggcaaaaaaaaacggcaaacuacugaauucagcguuucagagcuggcagaaccauucaaucgaugaacuauguaguuccuuuauaggacccacaggaucagaacguaagggccuguuugagcugaccucaagaggaucagcugccgacuucgaauuucuaggaguuaagauaccaagauacagagauuacacgccgagcucacuucuuaaagaugcaacucugauucaccaaucuguaacaggucuauaugagacucgaauagaccuagccaaauugggcgaagggaaacgaccugcagccacaaaaaaagcuggacaagcaaaaaagaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10336 - RNA, 3738 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccaaagaagaaacgaaaaguaggcauacacgguguacccgcggcagcagcauucaaaccuaauuccaucaacuacauacugggauuagauaucggcauagcauccguaggcugggcaaugguagagauugaugaggaagaaaacccgauuagauuaauagacuugggaguaagaguuuuugaaagagcagaggugccaaaaacaggagauucauuagcaauggcacggagguuagcacguucagucagaagauuaacaagaagacgugcacauagacuacuaagaacuagaagguuauuaaaacgugaagggguauuacaagcagcaaacuucgacgagaauggacuuauuaaaucauuaccuaauacuccauggcaacuacgagcagcggccuuagacagaaaauugacgcccuuagaauggagcgcaguacuguuacauuuaauaaaacaucgcggauaucuaucucagcguaaaaacgaaggagagacugccgauaaagaacucggugcacuacuaaaaggaguagcaggaaacgcacaugcacuacaaacgggagauuuuagaacaccggcagaacuggcauuaaauaaauuugaaaaagaaaguggucauauaagaaaucaaaggucagauuauagucauacauuuagucgaaaagaccuccaagcagaacuaauauuauuauuugaaaaacaaaaagaguuugggaacccccauguauccggagggcugaaagaagguaucgaaacacuacuuaugacgcaacggcccgcauuauccggugaugcaguacagaaaauguuagggcauugcacauucgagccugccgagccaaaagcagcuaaaaauacauacacugcagaaagguuuaucugguuaacaaaauuaaacaaucuuaggauucucgaacaaggaucagaaagaccuuuaacagacacagaaagagcaacgcuaauggaugaaccuuauagaaaaucaaaauuaacuuaugcacaagcacgaaaauuauugggcuuagaagacacagcguuuuucaaaggauuaagauauggcaaagauaaugcagaagcgagcacacuaauggaaaugaaagcauaccacgcuauaagccgagcauuagagaaagagggguugaaagauaagaaaucuccauuaaaccuuucuccagaacuccaagacgaaauagggacagccuuuucccuuuuuaaaaccgaugaagauauaacaggaagauuaaaagauagaauacaacccgaaauacuugaagcauuacuaaaacacauaucauuugauaaauuuguacaaauuagucuaaaggcuuuaagacgaauaguaccacugauggaacaaggaaaaagauaugaugaagcaugugcagaaauauacggagaccauuacggaaagaaaaauacggaagagaaaauauacuuaccaccaauaccggcagaugaaauuagaaacccaguaguucucagggcauuaagucaagcaagaaaaguaauaaauggaguagugagacguuacggaucuccugcgcgcauccauauagagacagcaagagaaguaggaaaaucauucaaagauagaaaagagauugagaaaagacaagaagaaaaucgaaaagaucgagaaaaagcggcagcuaaauuccgggaauauuucccgaauuuuguaggagaacccaaaucaaaagacauacuaaaauugagauuauaugaacaacaacaugggaaauguuuguauucaggaaaagaaaucaaucucgguagacuuaaugaaaaaggcuacguagaaauagaccacgcacuacccuuuagccggacaugggacgacagcuuuaacaacaaaguauuaguauuaggaagugaaaaucaaaauaaaggaaaccaaacuccuuaugaauauuucaauggaaaagauaacucuagagaauggcaagaauuuaaagcucgagucgaaacaucuagauuccccagaaguaagaaacaaagaauauuacuccaaaaauucgacgaagauggauuuaaagaaagaaaccuaaaugauacaagauacguuaauagauuucuaugccaauuugucgccgacagaaugagacuaacaggaaaaggaaagaaaaggguauuugcaagcaauggccaaauaaccaaccuguuaagagguuuuuggggacuaagaaaaguaagagcugaaaacgauagacaucacgcauuagaugcugucguaguggccuguagcacgguugcaaugcaacagaaaauuacuagauucguaagauacaaagaaaugaacgcuuucgaugggaaaacaauugauaaagaaacaggugaaguauuacaucagaaaacacauuuuccacaaccuugggaguucuuugcccaagaaguaaugaucagaguguuugguaaaccagaugguaaaccugaauuugaagaagcggauacauuagaaaaauuaagaacucuucuagcagaaaaauugucuucaaggccagaagccguacaugaguauguaacuccacuauuuguaagccgcgcaccuaaccgaaaaaugucuggacaaggacauauggaaaccgugaaaucagccaaacgguuagacgaaggugucucaguauugaggguuccacuaacacaauuaaaacuaaaagaucuggagaaaauggucaauagagaaagggaaccaaaauuauacgaagcacuuaaagcacguuuagaagcgcauaaagaugauccagcaaaagcauuugcagaacccuucuacaaauaugacaaagccggaaauaggacucagcaaguuaaagcaguaagaguagaacaaguucagaaaacgggaguauggguacgaaaccauaauggaauagcggauaaugcuacaaugguucguguagacguauucgaaaaaggagauaaauauuaucuagucccgauauauuccuggcaaguagcaaaggguauauuaccagauagagcaguaguacaaggaaaagaugaagaagacuggcaauuaauagacgauagcuuuaacuuuaaauuuucccuucauccuaacgacuugguagaaguaauaacgaagaaagcgagaauguuuggcuauuuugcaucaugccaucgcggaacagggaauauuaauauuagaauacacgaucuagaccacaaaauagguaaaaacgguauuuuagaaggaauugguguaaaaacagcucuuaguuuccaaaaauaccaaauugacgaguuagggaaagaaauacgacccuguaggcucaagaaaaggccaccaguaagaaaaagaccagcagccaccaagaaagcuggucaagcgaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10337 - RNA, 4494 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggccccaaaaaaaaaaagaaaaguaggaauacaugguguuccagcagcuaaaaaaccuuacaccaucggacuagacauuggaacaaauucgguagggugggcuguacuuacagaccaauacgaccucguaaaaaggaaaaugaaaauagcgggagacucugaaaaaaaacagauaaaaaaaaauuucugggggguuagacuauucgaugaaggacaaaccgcggcagacagacgaauggccagaacagcuaggcgaagaauugaaaggcgacgcaacagaauauccuauuuacaaggaauauuugccgaggaaaugucaaagacagaugccaauuuuuucugccgauugucagacuccuucuaugucgauaacgaaaaaagaaauagucgucaccccuucuuugccacgauagaagaggaggucgaauaccacaaaaacuacccaacuauauaccauuuaagagaagagcuaguaaacucaucugaaaaagcugaccuacggcuaguuuaccucgcauuagcgcauaucaucaaauaccgugguaauuuuuuaauagaaggagcuuuagacacacaaaacacaaguguagaugguauauacaaacaauucauacaaacuuauaaccaaguguucgccucaggaauagaagauggcucacuaaagaaacuagaagacaauaaggacguagcuaaaauauuagucgaaaaagugacacgcaaagaaaaauuagaacgaauucuaaaauuauauccaggagaaaagucagcaggaauguuugcccaauucauuucacuuauagugggaucaaaagguaacuuccaaaaaccauucgaccuaauugaaaaaagcgauauagaaugugcaaaagauagcuacgaggaagaucucgaauccuuacuagcacuuauaggagaugaauacgccgaauuauucguagcagccaaaaacgcuuacucggccgucguacugucaucgaucaucaccguagcagaaacagaaacaaacgcaaaacuuucagcaucaaugauagaacguuuugacacacaugaggaagauuuaggcgaauuaaaagcauuuauaaaacuucaccugccaaaacacuacgaagaaaucuucaguaacaccgaaaaacaugguuacgcaggauauauugacgggaaaaccaaacaagcagacuuuuauaaauacaugaaaaugacacuugaaaauauagaaggugccgacuauuuuaucgcgaagauagaaaaagagaacuucuuaagaaaacaaaggacuuuugacaacggugccauaccucaucaauuacaucuagaagaacuggaagccauauuacaccagcaagccaaauacuacccuuuuuuaaaagaaaauuacgauaagauaaaaucccuaguaacauuucguauaccauauuucguaggaccauuggcgaacggccaaucagaauucgcaugguuaacaagaaaagcagauggugagauaagaccauggaauauugaagaaaaaguugacuucgguaaaucagcuguggauuucauagaaaaaaugacaaacaaagacacauaccuuccaaaagaaaacguacuuccaaaacacucauuauguuaccaaaaauaccuugucuauaacgaauuaacaaaaguaagauauauaaacgaucaaggcaaaacaucauacuuuaguggucaagaaaaagaacaaauauucaaugaccuauuuaaacaaaaaagaaaaguuaaaaaaaaagaccucgaauuauuucuacguaauaugucacauguggaaucaccuacaaucgaaggacuugaagacuccuuuaacucuaguuacaguacauaucaugaccuccugaaaguuggcauaaaacaagaaauauuagauaauccuguuaauacagaaauguuggagaacauaguaaaaaucuuaacaguuuucgaagacaaacgaaugauuaaggaacaauuacaacaauucuccgacguacuugacgggguaguacuaaagaaauuagaacgaagacauuacacaggauggggacgcuuaagcgcaaagcucuugaugggaauccgagacaaacaaagccacuuaaccaucuuagacuauuuaaugaaugacgacggauuaaauagaaaucuaaugcaacuuaucaacgacuccaaucuauccuuuaaaucuaucaucgaaaaagaacaaguaacaacugcugacaaggacauacaaaguauaguagcagaucuagcaggaagcccagcaauuaaaaaaggaauauuacaaagucucaaaauaguugacgaauuagucucuguaaugggauacccgccacaaacgauaguuguagaaauggcaagggaaaaucaaaccacaggaaaagggaagaauaauucaagaccuagauauaaaucacuagagaaagcaauaaaagaguuuggaucacaaauuuuaaaggaacacccuacugauaaccaagaacuuagaaacaauagauuauaucucuacuaccuccaaaauggaaaagacauguauaccggucaagaucuggacauacauaaucucuccaauuacgacauagaccacauagugccacagaguuuuauaacggacaauuccauugauaaccuaguacuaacaaguagugcagguaauagggagaaaggcgacgacguaccacccuuagagaucgucagaaaacgcaaaguuuucugggagaaacuauaucagggaaaucuaauguccaagcgcaaauucgauuaccuaacaaaagcagagcgagggggcuuaacggaagcagauaaagcccgguucauacauagacaauuaguagaaacaagacagauaacaaagaaugucgccaacauuuuacaccaaagauucaauuacgaaaaagacgaucacggaaacacaaugaaacagguaagaauagugacauuaaaaucugccuuagucucacaguuucggaagcaauuucagcuauacaaaguucgagacguaaaugacuaucaucacgcacaugaugcuuaccuaaacggcguaguggcaaacacauuacuaaaaguauauccucaacuagaaccagaauucguauauggcgauuaucaccaguucgauugguuuaaagcaaauaaagcaaccgcaaaaaaacaauuuuacacaaauauuauguuauucuuugcccagaaagaccgaauuauagacgaaaacggagaaauauuaugggacaaaaaauaccuagacaccguaaaaaaaguaaugucauacagacagaugaacauaguaaaaaaaacagaaauccagaaaggugaauucuccaaagcuacaaucaaaccaaaagggaauucuagcaagcuaaucccaagaaaaacgaacugggaucccaugaaauaugguggacuagauucaccuaacauggcauacgcagucguaauugaauaugccaaagguaaaaacaaacucguguucgaaaaaaaaauaauuagagucacgauuauggaaagaaaagccuuugaaaaagacgaaaaagcuuucuuagaagagcaaggauaucgucaaccuaaaguauuagccaaauuaccuaaauacacauuauaugaaugcgaagaaggacgaagacgaaugcuagcaucggcaaacgaggcacaaaaaggaaaccaacaaguccuccccaaccacuuaguaacacuuuuacaccacgcagcaaauugcgaaguaucagauggaaaaucauuggauuacauagaaucaaacagagaaauguuugcugaauuacuagcacauguaucagaauuugcaaaaagguacacuuuagccgaagcgaaccucaacaaaauaaaccaacuauucgaacaaaacaaagaaggagauauaaaagcaauagcgcaaaguuuuguagacuuaauggcuuucaacgcgaugggagcaccagcaagcuucaaguucuuugaaacuaccauugaaagaaaacgcuauaauaaucugaaggaacuauuaaacuccacuauaauuuaucaaucaaucacuggcuuauacgaaagcagaaaacgauuagacgacaaaagaccugcagcaaccaaaaaagcaggacaagcaaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10338 - RNA, 4527 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcgccaaaaaaaaaaagaaaaguaggaauccaugguguccccgcagcaaaaaaaccauauuccaucggacucgauauaggcacuaauagcguagguugggcaguugucacagaugacuauaaaguaccagcaaaaaaaaugaaaguacuaggaaauacugacaaaucacacauagaaaaaaaccuacucggugcauuacucuuugacaguggaaauaccgcggaggauagaaggcucaaaagaacagccagacgacguuacacaagaagacgaaaucgaauacucuaccuacaagaaauauucucagaagaaaugggaaaaguugacgauucauuuuuucaucgguuagaagauuccuuccuaguuacagaagacaaaagaggggaaagacaccccauuuucggcaaucuagaggaagaaguaaaguaucacgaaaacuucccaacaauuuaucaccuuagacaauaucuagcugauaacccugaaaaaguagaucucagauugguauauuuagccuuagcacauauuauuaaguuuagaggccacuuucuaauugaaggcaaguuugauacacgcaacaacgacguccaacgguuguuucaagaauuuuuagcagucuacgauaacacauucgaaaauucaucacuacaagaacaaaacguucaagucgaagaaauacuaacagauaaaaucucuaaaucagcuaaaaaagacagaguccucaaacuauucccuaaugaaaaaucaaauggaagauucgcagaauuuuugaaauugaucgugggaaaucaagcagacuucaaaaaacauuucgaauuagaggaaaaagcaccacuacaguuuagcaaagauacauaugaagaagaguuagaagucuuacuagcucagauaggagacaauuacgcagaauuauucuuaagcgcaaaaaaacuauacgauuccauauugcuuaguggaauccuaacuguaacagacguuggaaccaaagcaccauuaucagcaagcaugauacaaagauacaacgaacaucaaauggaccuagcacaacuuaaacaauucauucgacaaaaacuaucugacaaauauaacgaagucuucuccgacgucagcaaggacggcuaugcaggcuauauagacggaaaaacaaaucaggaagcauucuacaaauaucuaaaaggucuacugaacaaaauugaaggaagcggauacuuccuugauaaaauagaaagggaagacuuccuaaggaaacaacgaacauucgauaauggaucaaucccacaucaaauacaucuacaagaaaugcgcgcuaucaucagacggcaagcugaauucuacccuuuccucgccgauaaccaagaccgaauagaaaaacuucuaaccuucagaauccccuauuacguaggaccacuagcucgcggcaaauccgauuuugcuugguuaucacgaaaguccgcagauaagauuacaccauggaacuuugacgaaauaguugacaaagaaucuucggcagaagcguucauuaaccgaaugacaaauuaugauuuauaucuacccaaucaaaagguacuuccaaaacacucacuacuauacgaaaaauuuacugucuacaacgaguuaacgaagguaaaguauaaaaccgaacaaggaaaaacugcuuuuuuugacgcaaauaugaaacaagaaauauucgaugguguauucaagguauauagaaaaguuaccaaagacaaguuaauggauuuccucgaaaaagaauuugacgaauucagaauugucgauuuaacaggacuagacaaggaaaacaaagucuuuaacgccucauauggaacuuaucacgaccuuuguaaaauccucgacaaagacuucuuagauaacucaaaaaacgaaaaaauauuagaagauauaguacuuaccuugaccuuguucgaagauagagaaaugauaagaaaaagacuagaaaacuauucagaucuccuaaccaaagaacaaguaaaaaaacuagaaagacgucauuacaccgguuggggcagacuaucagcagaauugauccauggcauacgcaacaaagaaucccgaaaaacaauacuagauuaucuaauugaugaugguaauucaaaccgaaauuucaugcaacuaauaaacgaugacgcacucucauucaaagaagaaauagcaaaagcacaaguaauaggugaaaccgacaaccuaaaccaaguaguaucagacauagcaggaaguccagcuauaaaaaaagguauucuacagucccucaagauagucgacgaacuaguaaaaauaaugggacaucaaccagaaaacaucguaguagaaauggcuagagaaaaccaauuuacaaaucaaggucgacgcaauucacaacaaaggcuaaaaggauuaacagauaguaucaaagaauucggaucacaaauauuaaaagaacacccaguugaaaauagucaacuacaaaaugaccgucuauuccuguacuauuuacagaacggacgcgacauguauacaggcgaagaacuagauauagacuacuuaucgcaauaugauaucgaucauauuaucccccaagcauuuauaaaagacaauucaauugacaaucguguucucacgucaucaaaagaaaacagagggaagagugaugauguaccuaguaaagauguuguacguaaaaugaaaucuuacugguccaaauuauuaucugcaaaauuaaucacgcaacgaaaauucgauaaccuaacaaaagcugaaagaggcggacugaccgaugacgacaaagccggcuuuauaaaaagacaauuaguagaaaccaggcaaauaacgaaacaugucgcacguauucuagacgagagguuuaacaccgaaacugaugaaaacaacaaaaagauaagacaaguuaaaauaguuaccuuaaaaaguaacuuaguauccaacuuccguaaagaauuugaauuauauaaagucagagaaaucaacgacuaccaccaugcucaugaugccuaccuuaacgcagucauugguaaagcccuacucggaguguauccccaauuagagccagaauucguauacggugacuacccacacuuccacggucauaaggaaaacaaagcaacagcaaaaaaauucuucuauaguaauaucaugaacuuuuuuaaaaaagaugacguacgaacagacaaaaauggggaaaucauauggaaaaaagaugaacacauuucaaauauuaagaaaguacuauccuauccccaagugaacauugucaaaaaaguagaagaacaaacagguggauuuucaaaagaaagcaucuuaccgaaagguaacuccgacaagcuuauaccccggaagaccaagaaauuuuacugggacacaaaaaaauacggaggguuugauucccccauaguugcauauucaauauuaguaaucgccgacauagaaaagggaaaaagcaaaaagcuaaaaaccguaaaagcauuaguaggagugaccauuauggaaaaaaugaccuucgaacgugauccagucgcauucuuagagcgaaaaggauauagaaacguucaagaagaaaauauaauaaaauugccaaaauacagucuauuuaaauuagaaaacggacgaaaaagacuauuagcaucggcacgggaacuccaaaaagguaacgaaauaguacuuccuaaucacuuagggacacucuuauaucaugcaaaaaacauacauaaaguagaugaaccaaaacaucucgacuauguugauaaacauaaagaugaauucaaagaauuauuagacguagugagcaacuucagcaaaaaauauacucuagccgagggaaaccucgaaaaaauaaaagaguuauacgcccagaacaacggagaagaucuaaaagaacuggcaaguagcuucaucaaccuauuaacuuucacagcaauaggagcaccagccacuuucaaauucuucgauaagaacauagacagaaaaagauacacuucgaccacagaaauauuaaaugccacauuaauacaccaaaguauaacaggacuauacgaaacaagaaucgauuuaaacaaauuagguggugauaaaagaccggcugcaacgaaaaaagcaggccaagccaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10339 - RNA, 3660 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaaaaagaaacgaaaaguagggauacacggcguaccagcagcacaaacaacuaauuuaaguuauaucuuaggacuagaucuaggcauagccucaguaggaugggccguuguugaaaucaacgaaaacgaagacccaauuggacucauagauguaggaguuagaauuuuugaacgagcugagguaccaaaaaccggagaaucucucgcucucucaaggcgauuggcaagaucuaccagacgacuuauaagaagaagggcacacagauuacuauuagcaaaaagauuuuuaaaacgagaagguauccuauccacaaucgaucuagaaaaaggauuaccaaaccaagccugggaacuuagagucgcaggccucgaaagacgucuauccgcaauagaauggggugcuguacuucuacaucuaauaaagcacagaggguauuuaucaaaaaggaaaaaugaaagucaaaccaauaauaaagaacuuggugcuuuacuaagugggguggcacagaaucaccaauuauuacaaucggaugauuauagaacuccagcugaacuggcauuaaagaaauucgcaaaagaagaaggacacauaagaaaucaaagaggagcguacacgcauacauucaacagacuagaccuauuagcugaauuaaauuuacuauucgcacaacagcaccaauuuggaaacccacauuguaaagaacacauacaacaauauaugacugaacuucuaauguggcaaaaaccggcauuaucaggagaagcaauauuaaaaaugcuuggaaaauguacccaugaaaagaaugaguucaaagcagccaaacauacuuauagugcagaaagauucgugugguuaacaaaauuaaauaacuuaagaauccucgaagauggagcugaacgagcacugaaugaagaagaaagacaacucuuaauaaaucauccauacgagaaaagcaaacucacuuacgcucaaguuagaaaacucuuaggauuaucggaacaagcaauauuuaaacaucuaagguauucaaaagaaaaugcagaaagugcaacauuuauggaauuaaaagcauggcaugcaauaagaaaagccuuagaaaaucaaggucuaaaagauacauggcaagauuuggcuaagaaaccagacuugcuagacgaaauaggaacugcauuuucguuauacaaaacagacgaagauauacaacaguaucugacaaauaaagugcccaauagcgugaucaacgcauuauuaguauccuugaauuucgauaaauuuauagaauugagccuaaaaaguuuaagaaaaauucuaccacuaauggaacaaggaaaaagauacgaccaagcaugccgagaaaucuacggacaucacuauggcgaagcaaaucagaaaaccagucaauuacucccagcaauuccagcacaagaaauacgaaaccccguaguacuaaggacacuaucucaagcacguaaaguaaucaaugcaauaauaaggcaauacggaucuccugccaggguacacauagaaacaggcagagaacuuggcaaaucauucaaagaaagaagagaaauacaaaaacaacaagaagauaauagaacaaaaagagaaagcgcaguacaaaaauuuaaagaguuauuuucugacuucuccucagagccuaaauccaaagauauucuuaaauuccgucuguaugagcaacaacauggaaaaugcuuauacagcggaaaagaaauaaacauacaucgacucaacgaaaaaggauacguagaaauagaucacgccuuaccauuuagccgaacaugggaugauucauucaacaauaaaguucuaguauuagcaagcgaaaaucaaaacaaaggaaaccaaacacccuaugaaugguugcaaggaaaaauaaauucagaacgguggaaaaauuucgucgcucuaguacuaggcagccaguguagcgcagcaaagaaacaaagauuauuaacgcaaguuauagacgacaauaaauuuauugacagaaaccuaaacgauacgcguuacauagcaagauuuuuaagcaauuacauccaagaaaacuuacucuuagucgggaaaaacaagaaaaauguauuuacgccaaacggacaaauaacagcucuacuuaggagcagauggggauuaauaaaagcaagagagaauaauaauagacaucacgcauuagacgcaauaguaguagcuugugcuacuccaaguaugcaacagaaaaucacgcguuucauuagauucaaagaaguacauccauauaaaaucgaaaauagauacgaaauggucgaccaagaaucaggagaaauaaucucaccgcacuuuccagaacccugggcauauuuucgacaagagguaaacauaagagucuucgacaaccauccagauaccgucuuaaaagaaaugcuacccgacagaccucaagccaaccaucaauuuguacaaccauuauucguuucaagagcacccacaagaaaaaugucaggacaaggacauauggaaacuauaaaaagcgcaaaacggcuagcagaaggaaucucuguucuacgaauacccuuaacacaauuaaaaccgaaucucuuagaaaacauggucaacaaagagagagaacccgcacuauacgcaggcuuaaaagcgcgauuggcagaauuuaaucaggacccagcaaaggcuuuugcgacaccauuuuauaaacagggaggacaacaaguuaaagcaauucgaguugaacaaguccaaaaaucgggagucuuaguaagagagaauaaugguguugcagauaaugcaucaauuguuagaaccgacguguuuauaaagaauaacaaauucuuccucgucccaaucuauacauggcaaguagcaaaagggauauuaccaaacaaggcaaucguagcucacaaaaaugaagacgaaugggaagaaauggaugagggagcaaaauuuaaguuuucauuauuuccaaaugauuuaguagaacucaaaacgaagaaagaauacuuuuucgguuauuauauaggacucgauagggcuaccggaaacauaucuuuaaaagaacacgacggagaaauaucaaaaggaaaagauggagucuaucguguuggagucaaacucgcacuuaguuuugaaaaauaccaaguugacgaacuuggaaagaauagacagauuugcagaccacaacaaagacaaccgguaagaaaacgaccugcggcaacaaagaaggcaggacaagcaaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10340 - RNA, 3738 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccuaaaaagaaaagaaaaguagguauacauggaguaccagcagcagccgcuuucaaaccaaacccaaucaauuacauucuaggucuugauauaggaauagcuaguguugggugggcaaugguagaaauagaugaagacgaaaauccaauaugcuuaauugauuugggaguaagaguauucgaacgagcagagguaccaaaaaccggagauagccuagcaauggcuaggcgauuggcccgaaguguaagaagauuaacacgacgacgagcgcaucgacuacuuagagccagacgguuacuaaaaagagaaggaguacuacaagcagcugauuuugaugaaaacggacugauaaaaaguuugccaaacacuccauggcaauuaagagcagccgcucuagacagaaaacuaacaccauuagaauggagugcagucuuguuacaucuaauaaaacauagaggauauuuaucccaaagaaagaaugaaggugaaacagcggauaaagaauugggagcguuacuuaaaggagucgcagauaacgcacacgcauuacaaacaggugauuuuagaacuccugcugaacucgcgcuuaauaaauucgagaaagaauccggacauauacgaaaucaacgaggugacuauucacacacauuuagcagaaaagauuuacaagcugaauuaauacuauuauuugaaaaacaaaaagaguucgguaacccacauguuucaggaggacuuaaggaaggaauagaaaccuuauuaaugacacaacguccagcauuaucaggagaugcaguacaaaagauguuaggucauuguacauucgaaccugcagaacccaaagcagcaaagaauacauauaccgcagaacgauuuauaugguuaacgaagcuaaacaauuuaagaauacuggaacaaggaagcgaacgcccuuuaacagacacagaaagagcuacauuaauggaugaaccauacagaaagucaaaacuuaccuaugcgcaagcaagaaaauuacuagggcuagaagacacugcuuucuucaaaggauuaagauacggaaaagauaaugcagaagcaucuacauuaauggaaaugaaagcauaccacgcuauaucaagagcauuagaaaaggaagguuugaaagauaagaaaucuccgcuaaauuuaucuccagaauuacaagaugaaauagguacagcauuuucuuuauucaaaacugaugaagauaucacaggcagguuaaaggaucgaauacaaccagaaauucucgaagcucuuuuaaagcauauuagcuuugauaaauuuguacagauaucacuaaaagcacuaagaagaauagugccacuuauggagcaagguaaaagauaugaugaagcaugugcagaaauuuacggcgaccacuaugggaagaaaaauacugaagagaaaauauacuuaccaccaauaccagcagacgaaauaagaaauccagucguacucagagcauuaagccaagcuagaaaaguuauaaauggaguagugagaagauauggaucaccagccagaauccauauagaaaccgcaagagaaguuggaaaaaguuuuaaagacagaaaagaaauagaaaaacgacaagaggaaaacagaaaagacagggaaaaagcugcagccaaauuccgugaauauuucccuaauuuuguaggagaaccaaaaagcaaagacauuuuaaaauuaagauuauacgaacaacaacaugguaaaugucuauauagcgguaaagaaauuaacuuaggcagacucaaugaaaaagguuacguagaaauagaccaugcuuuaccauucagcagaacuugggaugauagcuuuaauaacaaaguauuaguauuaggaucagaaaaucaaaacaagggaaaccaaacacccuacgaauacuucaauggaaaagacaacucaagagaguggcaagaauuuaaggcacgugucgaaacaucgagauuucccagaaguaagaaacagaggauuuuauugcaaaaauucgacgaagaugguuucaaagaaaggaaucuaaaugacacaagguauguuaauagauuccuuugucaauuuguagcagaucguaugagacuuaccgguaaagguaagaaaagaguuuuugcuucaaacgggcaaauaaccaauuuguuaagaggauuuugggggcuuagaaaagugagagcugagaacgaucgacaucacgcauuagacgcaguagucguagcauguaguacaguagcgaugcaacagaaaaucacccgauuuguaagauauaaagaaaugaaugcauuugacggcaaaacuauugauaaagagacaggagaaguauuacaucagaaaacacacuuuccacaacccugggaauuuuucgcacaagaaguaaugauaagaguauuuggaaaaccagauggaaaaccugaguucgaagaagcugacacacccgagaaacuucgaacccuuuuagcagaaaaauugaguaguagaccagaagcuguucacgaauauguaacacccuuauucguaagcagagcaccaaaccggaaaaugucaggacaagggcacauggaaacagucaaaagugcuaaacgacuggaugaagggguuagcguauugcgaguuccucuaacucaacuaaaacuuaaagacuuagaaaagaugguuaaucgagaaagggagccaaaauuguaugaagcacuaaaagcaagacuagaagcgcauaaggacgauccugcuaaagccuuugcugaaccguucuauaaauaugacaaagcaggcaaucgcacccaacaaguaaaagccgugaggguagaacaaguacagaaaacggguguuuggguaagaaaucacaacgguauagcagauaaugcuacuaugguucguguagauguauuugagaaaggagauaaguauuacuugguaccaauauauucuuggcaaguugcaaaagggauacuuccagacagagcaguaguacaaggcaaggaugaagaagauuggcaacuuauugaugacaguuuuaauuucaaauuuucauuacauccaaacgauuuaguagagguuauaacaaagaaagcacgaauguucgguuauuuugcuaguugccauagaggaacuggaaauauuaauauacguauacacgaccuagaucauaaaauagguaaaaauggaaucuuagaagguauaggcguuaaaaccgcucuaucauuccaaaaauaccaaauagacgaguuagguaaagaaauaagaccauguagauugaagaaacgcccuccaguuagaaaaagacccgcugccacuaagaaagcaggacaagccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10341 - RNA, 3744 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcacccaaaaagaaaagaaaaguaggaauacacgguguaccagccgcuaaauaccauguuggaauagauguugggacauuuuccguaggacuagcagcaaucgaaguagaugaugcaggaaugccuauuaaaaccuuaagucuaguaagucacauucaugauucagggcuagacccggaugaaauaaaaagcgcuguuacgcgacuggcgaguaguggaauagcccgucgaacuaggcgauuauauagaagaaaaagacguagguuacaacaauuagacaaauuuauacaaagacaaggauggccgguuauagaacuagaagauuauucugacccacuauauccuuggaaagugagagcagaauuagcugcuaguuacaucgcagaugaaaaagaacgaggggaaaaacuaucuguugcuuuaaggcauauagcaagacauagaggauggcguaacccauacgcgaaaguaagcagccuuuauuuaccagauggaccuagugacgcauuuaaagcaauaagagaagaaauuaaaagagcgaguggacaaccggucccagaaacugcaacaguaggacaaaugguaacgcuaugcgaauuaggaacacuaaaauugagaggcgaagguggggugcuaucagccagauuacaacagucugauuaugccagagaaauacaagaaauaugucgaaugcaagaaauaggacaagaacucuauagaaaaauaauugauguaguuuucgcagcugaaaguccuaaagguuccgcaucgaguagggugggaaaagauccauuacaaccaggcaaaaaucgcgcauuaaaagcaucagaugcauuccagcgauacagaauagcggcuuuaauaggaaaccuccgagugagaguagacggagagaaaagaauccuaagcguagaagagaaaaaccuaguauucgaccacuuagucaaucuaacacccaagaaagaaccggaauggguaacuauugcagagauacuggggauagauagaggccaauuaaucgguacagcaacuaugacagaugauggggaaagggcuggugcaagaccgccaacgcacgauacaaaucgaaguauaguaaauucaagaauagcaccacugguagauugguggaaaacagcaagcgcauuagaacaacaugcgaugguaaaagcauuaaguaaugcugaaguagacgacuucgacaguccagaaggagccaaaguacaagccuuuuucgccgauuuagacgaugauguacaugccaaauuagauagucuccaccuaccuguaggacgagcagcauacagugaagacacucuaguacguuugacacguaggaugcuaucagauggaguggacuuguacacagcaagguuacaagaguuuggaaucgaaccuaguuggacaccaccgacacccagaauaggagaacccguagguaaccccgcaguugauagaguauuaaaaacaguuagcagaugguuagagagugcaaccaaaaccuggggagcuccugagagggucauuauagaacauguuagagaaggauucguuacagagaaaagagcaagagaaauggauggagauaugagaagacgagccgcccguaaugcaaaacuauuccaagaaaugcaagaaaaacucaacguucaagguaaaccuaguagagcagauuuauggagauaucaaagcguacaaagacaaaacugucaaugcgcuuacugcggcucaccaauaacauucuccaacagugaaauggaccacauuguaccccgugccggucaagguucaacuaauacuagagaaaaucuaguagcaguuugucaucgaugcaaucaaucuaaaggcaauacaccguuugcaauaugggccaaaaauacaucaauugaagguguaucgguaaaagaagcagucgaaaggacaagacacuggguaacagauacugguaugagauccaccgacuucaagaaauucacuaaagcaguaguggaaagguuucaaagagcaacaauggaugaagaaaucgacgcccguucaauggaaagugucgcauggauggcuaacgaauuaagaagucgaguagcacaacacuuugcaucacaugggacgacuguaagaguauauagaggaucgcuaacagcagaggccaggcgagcaagcgguauaagcggaaaauuaaaauucuucgauggcgucgggaaaaguaggcuggacagaagacaccaugcaaucgaugcagcggugauugcauuuacauccgacuacgucgccgagacauuggcggucagaaguaaucuuaaacaaucccaggcacaccgacaagaggcaccacaauggagagaauuuacaggaaaagaugcagaacaucgagccgcuuggagaguuuggugucagaaaauggaaaaacuaagugcacuucuaacagaggauuugagagaugauagaguaguaguuaugagcaauguaagacucagauuaggaaacggaucagcucauaaagaaacaauaggaaaauuaaguaaagucaaauuaagcucacaacuaucaguaucugauauugacaaagcaucaagcgaggcuuuauggugugcguuaacaagagaaccuggguuugauccaaaagaagguuuaccagccaauccagaacgucacauccgaguaaauggcacacacguuuaugcaggggauaauauaggccuauuuccuguaucagcaggaaguauagcucuuagaggaggauaugcagaauuaggaucaaguuuucaccaugccagaguauauaaaaucacauccggaaagaaaccagcauucgcaaugcuuagagucuauacaaucgaccuacuaccguacagaaaccaagaccuauuuuccguggaauugaaaccacaaacaaugaguaugagacaagccgaaaagaaauuaagagacgcacucgcaacuggaaacgcagaauaucucggcuggcuaguaguugacgaugaauuaguagucgacacaaguaaaauagcaacagaccaaguaaaagcuguugaagcagaauuaggaacgauaagacgauggagaguagauggauucuuuuccccaaguaaacuaagauuaaggccauuacaaaugaguaaagaagguauuaagaaagaaagugcaccagaacuaucuaaaauuauagaucguccaggcuggcuaccagcugugaauaaacuauuuucggaugguaauguuacaguuguuagaagggacucauuaggcaggguucgccuggaaucuacagcacacuugccaguaacuuggaaaguucagaaaagaccagcagcuacgaagaaagcaggacaagcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10342 - RNA, 3444 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggccccaaaaaaaaaaagaaaaguaggcauacauggcgugccagcagccgcaagaauacuugcguuugauauaggaaucagcucaauagguugggcuuucucagaaaaugaugaacucaaagauuguggcgucagaauauuuacaaaaguagaaaacccaaaaacuggagaaucauuggccuuaccacguagacucgcaagaagcgcaagaaaacgacucgcacgaagaaaagcuagauuaaaccaccuaaaacaccuuauagcgaaugaauucaaacucaauuacgaagacuaccaaucauucgacgaaagccuagcaaaagcauauaaaggaucgcucauaaguccguacgaacuaagguucagagcacuuaaugagcuacuaaguaaacaagacuucgcucgugucauauuacacauugcaaaacggaggggauaugacgauauaaaaaauagcgacgauaaagaaaaaggagcaauuuuaaaagcaauaaaacaaaacgaagagaaacuggcaaauuaccaaucuguaggagaauauuuauacaaagaauauuuccaaaaauucaaagaaaacucaaaagaauuuacuaacguucgaaauaaaaaagaaaguuaugaaagaugcauugcacagagcuuccuaaaagacgagcugaaacuaauauuuaaaaaacaacgagaauucggcuucucguuuucaaaaaaauucgaagaagaaguccuaucugucgcuuucuacaaacgagcccuaaaagacuuuagccauuuaguuggaaacugcucauuuuucacagaugaaaaacgagcuccaaaaaauucacccuuagcauucauguucgucgcgcuaacucgcauuauaaacuuacuaaacaaucuuaaaaauaccgaaggcauacuauauacaaaagaugauuugaacgcauuacuaaacgaaguguuaaaaaauggaacccugaccuacaaacaaacaaagaaacuacucggucuuucagacgauuacgaauucaaaggcgaaaaagguacauacuucauagaauucaaaaaauacaaagaauuuauaaaagccuuaggagaacauaaucuaucucaggaugacuuaaacgaaaucgccaaagauauaacacuaauaaaagacgaaaucaaacuaaaaaaagcuuuggcaaaauacgaccucaaucaaaaucaaauugauagucuaucaaaacuagaauuuaaagaccaccuaaauauaucauuuaaagcacuaaaauugguaacaccacuaaugcucgaaggcaaaaaauacgaugaagcgugcaacgaauugaaccuaaaaguagcuaucaaugaggacaaaaaagacuuccuaccagcuuuuaacgaaacauacuacaaagacgaaguaacaaacccaguaguacuaagagcaauaaaagaauacagaaagguacugaacgcacuccuaaagaaauaugggaaaguccacaaaauaaacauagaacuagcaagggaaguaggcaaaaaccacucacaaagagcaaaaauugaaaaagagcaaaacgaaaauuauaaagccaaaaaagacgcagaauuagaaugugaaaaacuuggauuaaagauuaacucaaaaaacauauuaaaacuacgccuauuuaaagaacaaaaagaauucugugcauacaguggggagaaaaucaaaauaucagacuuacaagaugaaaaaauguuggaaaucgaccauauuuauccauacagcagaaguuucgacgauucauauaugaauaaaguguuaguauucacaaaacaaaaccaagaaaaauuaaaccaaacuccauucgaagcauuugguaacgacuccgcaaaauggcagaaaauagaaguacuagcaaaaaaucuaccgacaaaaaaacaaaaaagaauauuagacaagaacuacaaagacaaagaacaaaagaauuucaaagaucgaaaccuuaaugauacaagguauaucgcaagacuuguacuaaacuacacaaaagauuacuuagauuucuugccuuugucagacgacgaaaacaccaaauuaaacgacacucaaaaagguucgaaaguacauguagaagcaaaaucaggaaugcuaaccagcgcacugcgacacaccuggggcuuuagcgcaaaagauagaaacaaucacuuacaccacgcaauagacgcagucauuauugcauacgcuaacaacucuauuguaaaagcuuucuccgacuuuaagaaagaacaagaaagcaauucagcugaacuuuaugccaaaaaaaucucggaacuggacuacaaaaauaaaaggaaauuuuucgagccauucaguggguuuagacagaaaguucuagacaaaauugaugaaaucuuuguaucaaaaccagaaagaaaaaaaccuucuggagcccuacacgaagaaacauuuagaaaagaagaagaauucuaccaaucauauggcgguaaggaaggcguauugaaagccuuagaauuaggaaaaauccgaaaaguaaacggaaaaauaguaaaaaacggcgacauguuccggguugauauauucaaacacaaaaagacaaacaaguuuuacgcagucccaauauacacuauggacuucgcccuaaaaguacuaccuaacaaagcuguagcaagaucaaaaaaaggcgaaauaaaagauuggauauuaauggacgaaaacuaugaauucugcuucucccuauauaaagauagccuuaucuuaauacagacaaaagauaugcaagaaccagaguuugucuauuacaaugcuuuuacuaguucaacuguaagccuaauaguaagcaaacacgacaauaaauuugaaacacuaucaaaaaaccaaaaaaucuuauuuaagaacgcuaacgaaaaagaagucauagcaaaaucaauaggaauacaaaacuuaaagguuuucgaaaaauauauuguaucagcacuaggagaaguaacaaaagcagaauucagacaacgagaagacuuuaaaaaaaaacgaccagcagcaacaaaaaaagcuggacaagccaagaaaaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10343 - RNA, 3855 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcacccaaaaagaaacgaaaaguagggauccauggagugccagcagcaucagaccuaguuuuaggucuagacauaggaauuggaucaguaggagucggaauacugaacaaaguaacuggugaaauaauacacaaaaauucaagaauauuuccagcagcacaagcagaaaauaaccuagugagacgaacaaauagacaaggaagaagacuggcacguaggaagaaacauagaagaguaagauuaaacagacuauucgaagaaucaggacuaauuacagauuucacuaaaauaaguaucaaccuaaacccauaccaacuuaggguuaaaggauuaacggacgaauuaucaaacgaagaacuauucauugcacucaaaaacaugguuaaacauaggggaauauccuaccucgacgacgcuucugaugaugguaauagcucggucggagacuaugcacaaauaguaaaagaaaauagcaaacaacuagaaaccaaaacuccgggacaaauccaacuugaaagauaccaaacauauggacaacuaagaggagacuucacaguagaaaaagacggcaagaaacaucgcuugauaaacguauuccccacaucagcauauagaagugaagcacuaagaauauuacaaacacaacaagaauuuaacccacaaauaacagaugaauuuauaaacagguacuuagaaauccuaacaggaaaaagaaaauacuaucacggcccgggaaacgaaaaaucaagaacggauuauggaagauaccggacaagcggggaaaccuuagauaauauauucggaauacuaaucggaaaaugcacuuuuuacccugaugaauuuagagcggcaaaagcaucauacacagcacaagaauuuaauuuacucaaugaccuaaauaacuuaacaguaccaacagaaaccaagaaacuaucaaaagaacagaaaaaccaaauaauaaacuacgucaaaaaugaaaaagcuaugggcccugcaaaauuauucaaauauauagcaaaacuacuaagcugcgauguugcggacauuaaaggguauagaauagacaaaaguggaaaagcagaaauucacaccuuugaagcauacagaaaaaugaaaacauuagaaacgcucgauauagaacaaauggaccgcgaaacgcuagauaaacuagcuuauguacucacucuuaacacagaacgcgaaggaauacaagaagcccuagaacacgaguucgcagacgguucauuuucacaaaaacaaguagaugagcuaguacaauuucgaaaagccaacucgucaauauuuggaaaaggauggcacaacuucaguguaaaauuaaugauggaacucauacccgaacuuuacgaaacaucagaggaacaaaugacaauauuaacaagauuaggaaaacagaaaacaacaucaaguucuaacaaaacuaaauacauagacgaaaaacuauuaacugaagaaauauacaauccagucgucgcaaaaagcguacgacaagcgaucaaaauagugaaugcugcaaucaaagaauauggcgauuuugacaauaucguuauagagauggcacgcgaaacaaacgaagaugaugagaagaaagcuauacagaaaauacaaaaagcaaauaaagaugaaaaagaugcagcuauguuaaaagcugccaaccaauauaacggaaaagccgaauuaccacauucaguauuccaugggcacaaacaauuggccacaaaaaucagacuauggcaucaacaaggcgagcgaugccuauacacaggaaaaacuaucuccauacacgaccugaucaauaauaguaaccaauucgagguagaccacauacuaccacuaucgauaacauucgaugauagcuuggcgaauaaaguccuuguguaugcuacggcaaaccaagaaaaaggccagagaacuccuuaccaagcccuagacagcauggacgaugcauggucauucagggaauuaaaagcauuuguuagagaaucuaagacucuaaguaacaaaaagaaagaauaccuucuuacggaagaagacauaaguaaauuugaugugcggaagaaauucaucgaaagaaacuuaguagacacuagauaugcgucacgcgugguacuaaacgcucuacaagaacacuucagagcacacaaaauugacacuaaagucaguguugugagaggacaauuuacaagccaacuaaggagacauugggguauagagaaaacaagggauacuuaucaucaucacgcuguugaugcacugaucaucgccgcaagcagucaacuaaauuuauggaagaaacagaaaaacacauugguaagcuauagcgaagaccaauuacuagacauagaaacuggagaacuaauaucugaugacgaguacaaagaaaguguuuuuaaagcaccuuaccaacacuuuguagauacauuaaaaaguaaagaguucgaagauucaauacucuucucuuaucaaguagacagcaaauucaacaggaaaauaucagacgccacaauauacgcgacuaggcaagcaaaaguaggaaaagauaaagcagacgaaacguacgucuuagggaaaaucaaagauauuuauacacaagacgguuacgaugccuucaugaaaauauauaagaaagauaaaaguaaauuucugauguaucggcaugauccucaaacauuugaaaaagucauugaaccuauacuggaaaauuacccaaauaaacaaauaaacgaaaaagguaaagaaguaccauguaaucccuucuugaaauauaaagaagaacacggauacauaagaaaauacucuaagaaaggaaauggaccggaaauaaaaagccugaaauauuaugacagcaaauuaggaaaucacauagauauaacgcccaaagacucgaauaacaaagucguauuacaaaguguuagcccauggagagcagauguuuauuucaacaaaacuacugguaaauaugaaauucuaggguuaaaauaugccgaucuucaauuugaaaaagggacggguacauauaaaauaagccaagaaaaauauaaugauauuaaaaagaaagaaggaguugacuccgauucagaguucaaauuuacucucuauaaaaacgacuuacuccuagucaaagauacggaaacaaaagaacaacaacuauucagauuccuuucaagaacaaugccaaaacaaaaacacuacguggaacuuaaaccguaugacaaacaaaaauucgaaggaggagaagcauuaauaaaaguauuagguaacguagccaauagcgggcaauguaagaaaggguugggaaaauccaacaucagcauauauaaaguuagaacagauguacuaggcaaucaacauauaaucaaaaacgaaggcgacaaaccaaaacuagauuucaaaagacccgcagcaacuaaaaaggcaggacaggccaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10344 - RNA, 4413 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccuaaaaagaaacgaaaaguaggcauccauggagucccagcagcaacccaguucgaaggauucacuaacuuauaucaaguauccaaaacccuaagauuugaauuaaucccacaagguaaaacacuaaaacauauccaagaacaagguuuuaucgaagaagacaaagcccgaaacgaucacuacaaagaacuaaaaccaauuauagauagaauauacaaaaccuaugccgaucaaugccuucaacuuguccaauuagacugggaaaauuuaucagcugcgauagacucauacagaaaagagaaaacagaagaaacaagaaacgcacuuaucgaagaacaggcaacauaccgaaacgcuauacacgacuauuuuauagguagaacagacaaucuuacggaugcuauaaacaaaagacacgcagaaauuuacaaaggacucuuuaaagcagaauuauuuaaugggaaaguacuaaaacaacuaggaacuguaacaaccacugaacacgagaaugcacugcugcgcucuuucgacaaauuuacgacuuacuucuccggguucuacgaaaacaggaaaaaugucuucagcgcugaagacauaucuacugcaaucccacauagaaucguccaagacaacuuuccaaaauuuaaagaaaacugccauauauuuacccgccuuauuaccgcaguucccucccuacgugaacauuucgaaaaugucaagaaagcgauagguaucuucgucucaacaaguauagaagaaguuuucagcuucccauuuuauaaucaauuacuaacucaaacacaaauagacuuauacaaucaacuucucgguggcauuagccgagaagcgggaacagagaaaauaaaaggucuaaaugaaguguuaaaccuugcaauucagaaaaacgaugaaacugcacacauuauagcaagucuaccgcaccguuuuauaccacuauucaaacaaauucuuagugaccggaauacccugucauucauucuagaagaguucaaaucugaugaagaagucauccaaaguuucugcaaauacaaaacacuacuaagaaacgaaaacguguuagaaacagcagaagcacucuucaacgaacucaauuccauagaccucacacauauauuuaucucccauaaaaaguuagaaacaauaucuagugcucugugcgaccacugggacacacuaagaaacgcauuauacgaaagaagaauuagcgaauuaaccggaaaaauaacuaaaagugccaaagagaaaguccaacgaucacugaaacacgaagacaucaaccuacaagaaaucaucucugcagccggaaaagaacuaucugaagcguucaagcagaaaacuuccgagauauuaucucacgcccaugcagcauuagaccaaccccucccaacaacucuaaagaaacaagaggaaaaagaaauauuaaaaucacaacuggauuccuuauuaggcuuauaccaucuuuuagacugguucgcaguugaugaaaguaacgaagucgaucccgaguucagcgcccgacuaacgggaauaaaacuggaaauggaaccaagccuuucauucuacaauaaagcucgaaacuacgccacgaagaaacccuauuccgucgaaaaauucaaacuuaacuuucaaaugccaacgcuagcaucagguugggaugucaacaaagagaaaaacaacggagccauacuauucgucaaaaacggccuauauuaucuagggauuaugccaaaacaaaaaggaagauacaaagccuuaucauuugaaccuacugagaaaacaucugaaggauucgauaaaauguacuacgauuauuuuccagaugcugcuaaaaugaucccaaaaugcucaacacaacuaaaagcaguaacagcacacuuucaaacucauacaaccccgauccuacuaaguaacaauuuuauugaaccccuagaaaucacgaaagaaaucuacgaucuaaacaauccagaaaaagaaccuaagaaauuccaaaccgccuaugcgaagaaaacaggagaucaaaaaggauacagagaagcacuauguaaauggauugauuucacaagagacuuccucagcaaauauacaaaaacaacaagcauagacuuaaguucuuuacgcccaucuucccaauacaaagauuuaggcgaauauuaugcagaacuuaacccacuccuauaucauauaucuuuucaacgcaucgcugaaaaagaaauaauggacgcagucgaaacaggaaaacuauaucuauuccaaaucuacaauaaagacuuugcgaaaggccaucacggaaaaccaaaucuccacacacuuuauuggacaggauuauucagcccagaaaaccuagcaaaaaccucaauaaaauuaaacggccaagcagaacuguuuuaucgcccaaaaucuagaaugaaacgaauggcucaccgccuuggggagaaaaugcuaaauaagaaauuaaaagaccagaaaaccccaauaccagauacucuuuaccaagaacucuacgauuacgucaaucaccgacuaucucacgaucuauccgacgaagccagagcccuguuaccgaauguaaucaccaaagaagucucacacgaaauaauuaaagaccgacgcuucacauccgauaaauuuuucuuucacguuccaauaacacuaaauuaucaagcugccaacuccccaagcaaauucaaucaacgcguaaacgcauacuuaaaggaacacccagaaacaccaaucaucgguauagaccgcggcgaacgaaacuuaauauauauaacaguuauagauucaacuggcaaaauauuagaacaacgaucacuuaacacaauccaacaauucgacuaccaaaagaaacucgacaauagagaaaaagaaaggguggcugcuagacaagcauggucuguagucggaacaauaaaagaccuaaaacaaggauaccuaucucaaguuauacacgaaauaguagauuuaaugauucauuaccaagcgguaguuguacuagaaaauuuaaacuuuggauuuaaaagcaaacgaaccggcaucgcugaaaaagcaguauaccaacaauuugaaaagaugcuaauagauaaauuaaauugccuugugcuuaaagauuacccagccgaaaaaguagggggaguuuugaauccauaccaauuaacugaccaauucaccuccuuugcuaaaauggggacccaauccggcuuccucuuuuacguacccgcgccauacaccagcaaaauugacccucuuacgggcuucgucgauccauuuguuuggaaaacaauaaagaaccacgaaucuagaaaacacuucuuagaaggauuugacuuccuacauuacgacguaaaaacaggagauuucauacuacacuucaaaaugaacagaaaucuuucauuccaacgaggccuuccuggauucaugcccgcuugggacauagucuucgagaaaaaugaaacgcaauuugaugcaaaaggaacgcccuuuaucgcagguaaacgaauuguaccgguaauagaaaaucauagguuuacgggacguuauagagaccuauauccagcuaaugaacuuauagcuuuauuagaagaaaagggaaucguauuucgugacgguucaaacauacuacccaaguuacuagaaaacgacgauucacacgcaauugauacaaugguagcuuuaauaagaagcguccugcaaaugagaaauucuaaugcagcaacaggagaagauuacaucaacucaccaguacgagaucuaaauggcgugugcuuugauucacgcuuccaaaacccagaauggccaauggaugccgacgcaaauggcgcuuaccacaucgcacuaaaaggccaacuacuacugaaucaccuaaaagaauccaaagaccucaaacuucaaaacgggauaagcaaccaagauuggcucgcuuauauacaagaacuacguaauaagcgaccggcagcaacaaagaaagccggccaagccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10345 - RNA, 4392 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccaaaaaaaaaacgcaaaguaggcauacauggagugcccgccgcaucgauuuaccaagaauuuguaaauaaauacucacuuucaaaaacguuacgcuucgaauuaaucccacaagguaaaacacuagaaaacauaaaagcacguggacucauacuagaugacgaaaaaagagcaaaggacuauaaaaaagcaaaacaaauaaucgacaaauaucaccaauucuucauagaagaaaucuuaucaaguguuuguauaagugaagacuuacuacaaaacuauagugauguauauuucaaacuaaaaaaaagcgaugacgacaaucuccaaaaagauuucaaaagcgcaaaagacacuauaaagaaacaaauaucagaauauauaaaagacucagagaaauucaagaaccuauucaaccaaaacuuaauagaugcaaaaaaaggacaagaguccgaucuaauacuauggcugaaacaaucuaaagauaacggaauagaauuauucaaggccaacuccgauauaaccgauaucgacgaagcauuagagauaauuaaauccuucaaaggauggacuacuuauuucaaaggauuucaugaaaauagaaaaaacguauacuccucuaacgauauucccacuuccauuaucuauagaauaguagaugacaaccucccaaaauuuuuagaaaacaaagcaaaauacgaaucccuaaaagacaaagcuccggaagcaauuaacuaugaacaaaucaagaaagauuuggccgaagaacuaaccuucgacauagauuauaaaacaucagaaguaaaucaaagaguauuuucuuuagacgaaguauucgagauugcaaacuucaauaauuacuuaaaucaaucaggcauuacaaaauucaacacaaucauaggaggcaaauucgucaacggagaaaacaccaaaagaaaagggauuaaugaauauaucaacuuauauucacaacaaauaaaugauaaaacccuaaaaaaauauaaaaugagugugcuauuuaaacaaauauuguccgacaccgaaagcaaaucauucgugauagacaaauuagaagacgauagugauguaguaacuaccaugcaaucauucuaugaacaaauagcagcauuuaaaacagucgaagaaaaaaguaucaaagaaacacuuucacuauuauucgacgacuuaaaagcacaaaaauuagaccucaguaaaaucuauuuuaaaaaugacaaaucauuaacugauuuaucccaacaaguauucgacgacuacagcgucauuggcaccgccguucuagaauacauaacacaacagaucgcaccuaagaaccuugauaauccuucuaaaaaagaacaagaacucauagcaaaaaaaacagaaaaagcaaaauaccucagucuugaaacaauaaaacucgcacuagaagaauucaauaagcaccgagauauagauaaacaaugucgauucgaagaaauucuggccaacuuugcagcuaucccaaugaucuuugacgaaauagcacaaaauaaggacaacuuagcacaaauuucaauaaaauaucagaaccaaggaaagaaagauuugcuccaggcgagcgcugaggacgacgucaaagccauaaaagaucuucuugaucaaacaaacaauuuacuacacaaacuaaagauuuuccacauaagucagucagaagacaaagcaaacauauuagauaaggaugaacauuucuacuuaguauucgaagaaugcuauuuugagcucgcaaauauaguaccacuguacaauaaaauccggaauuacaucacucaaaaaccuuauucagacgaaaaguuuaaacuaaauuucgagaauuccacauuagcaaauggaugggacaagaacaaagaacccgacaauaccgcuauuuuauucauuaaagaugacaaauauuaccucggcgugaugaauaaaaaaaacaauaagauauucgacgacaaagcuauaaaagaaaacaaaggagaaggauacaaaaaaauuguauauaaacuccucccaggagcaaacaaaauguugccaaaagucuucuucucagcaaaguccauaaaguucuacaaucccagcgaagacauccuuaggauuagaaaucacuccacacacacuaaaaacggaucaccccaaaaaggcuacgaaaaauucgaguucaacauugaggacugcaggaaauucaucgauuuuuacaaacaaaguaucucaaaacauccagaauggaaagacuuuggcuuuagauuuucagauacacaaagauacaacuccauagaugaguuuuauagggaaguagaaaaccagggauacaaguuaacauucgaaaacauaagugagucauacauagacagcguugugaaccaaggaaagcucuaucuauuccaaauauauaacaaagacuuuagcgcauacuccaaaggaagaccaaaccuacacacauuauauuggaaagcacuauuugacgaaaggaacuuacaagacguuguuuauaaacuaaauggugaagcagaacuauucuauagaaaacaaucaauacccaagaaaaucacccacccagccaaagaggcaaucgcaaauaagaauaaagauaacccaaaaaaagaaucggucuucgaauacgaccucauaaaagacaagcgauuuaccgaagauaaauucuucuuccacugcccaaucacaaucaauuucaaaagcucaggggcaaacaaauuuaaugacgaaauaaaccuacuauuaaaagaaaaggcaaaugauguacauauacucucaauagacaggggcgaaagacaucuagcauacuacacacucguagauggaaaaggaaauaucauaaaacaagauacauucaacauaaucgggaacgaccggaugaagacgaauuaccacgauaaacuagcagcuauagagaaagacagagauuccgcaagaaaagacuggaaaaaaaucaacaacaucaaagagaugaaagaaggcuaucugagccaaguaguucacgagauugcaaaacuuguaauugaauacaaugcaauagugguauuugaggaccucaacuucggauucaaaaggggucgauucaaaguagaaaaacagguuuaccaaaaacuagaaaaaauguuaauagaaaaacuaaacuaucuaguauuuaaagacaacgaauucgauaagaccggcggaguacuaagagcauaucaauugaccgcaccauuugaaacauucaaaaaaauggguaaacaaacuggaauuauauauuacgucccagcaggcuucaccucaaaaauauguccaguaacgggauuuguaaaccaauuauaucccaaauaugaaucaguuucuaaaagucaagaguuuuucagcaaauucgauaaaauaugcuacaaccucgacaagggauacuuugaauucucauucgacuauaaaaauuuuggagacaaagcagccaaagguaaguggacgauagcaaguuucggcucaaggcuaauaaacuucagaaauucugacaaaaaucacaauugggacacuagggaaguauaccccacgaaagaacuagaaaaauuacuaaaagauuacucuauagaauaugggcacggggaauguauaaaagcagcaauaugcggcgaaucagacaagaaauucuucgcaaaauuaacuucagucuuaaacacuauucugcaaaugcgaaauaguaaaacuggaacugaguuagacuauuuaauaucacccguagccgacguaaauggaaacuuuuucgacucaagacaagcaccgaaaaauaugccacaagaugccgacgcuaacggagccuaucacauaggccuuaaagguuugauguuauuaggcagaauaaaaaacaaccaagaaggaaaaaaacuaaaucucguaaucaagaacgaagaauacuuugaauucguacaaaaccgcaauaauaaacgacccgcagcaacaaaaaaagcugggcaagcaaaaaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10346 - RNA, 4596 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaaaaagaagagaaagguaggcauacacggcguccccgccgccgacaaaaaguacucaaucggccuugacauaggcacuaacucuguuggaugggcuguaauaacggaugaauacaaaguacccagcaagaaauuuaaaguacuggggaacaccgaccgacacucaauaaagaaaaaucuuauuggcgcacuccuguucgacucgggcgagaccgcggaagcgacucgccuaaaacggacggcccgccgacgcuacacgagacgcaagaaccgcauaugcuaucugcaagagauauucucgaacgaaauggcaaaagucgacgacagcuucuuccacagguuagaagagagcuuccucgucgaagaagacaagaagcacgaacgucauccaauauucggcaauauaguggacgaaguggcauaccacgagaaauauccaacgaucuaccaucugcggaaaaagcugguagauuccaccgacaaagcagaccuccgccuuaucuaccuagcacuggcccacaugaucaaauuccgcgggcacuuccucaucgaaggagaccuaaaccccgauaacuccgacgucgacaaacuauucauccaauuaguccagacauacaaccaacucuucgaagaaaaucccauaaaugccuccggcgucgacgcaaaagccauccucucggcgagacucucuaagucacgucgcuuagaaaaccucauugcacaacugcccggagaaaagaaaaacggccucuuuggaaaccuaaucgcccucagccucggacucacacccaacuucaaauccaacuucgaccucgccgaagacgccaaacuacaacuaagcaaagauaccuacgacgacgaccuggacaaccugcuggcacaaaucggggaccaguacgcggaucuguucuuagccgccaaaaaucucuccgacgcgauucugcuaucggauauacuucgaguaaacaccgaaaucacgaaagcaccccucuccgccucgaugaucaaacguuacgacgaacaucaccaggaccucacacuccuaaaagcacucgugcgccagcaacugcccgagaaguacaaggaaaucuucuucgaccagucgaaaaacggcuacgccggguacaucgacgggggcgcaucccaagaagaguucuacaaauuuauuaaaccgauacuggagaaaauggacggaacugaagaacugcucgucaagcugaaccgugaagaccuucuccgcaaacagcgaacguucgacaacggcucaaucccccaccaaauucaccucggagaacuacaugccauccuacgacgucaagaagacuucuacccauuucucaaggacaaccgcgagaaaauugagaaaauacucacauuccggauccccuauuacgucgggccacucgcccggggcaacucacgcuucgcauggaugacccggaaaagugaagaaaccaucacacccuggaacuucgaagaaguaguagacaaaggcgcaagcgcccaaucauuuauagaacgaaugacaaacuucgacaaaaaccucccaaacgaaaaaguacuacccaagcacucacuucucuacgaauacuucacagucuacaacgaacucacuaaagucaaauacguuacagaagggaugcggaaacccgccuuccucuccggugaacagaaaaaggccauuguggauuuacucuucaagaccaaccgaaaagucacugucaagcagcucaaggaagauuacuucaagaaaauagaaugcuucgacagcguagaaauaucaggagucgaagaccgcuucaacgccagccucggaaccuaccacgaccugcuaaaaaucaucaaagauaaagacuuccucgacaacgaagaaaaugaagacaucuuggaggacauaguuuuaacccuaacccuguucgaagauagggaaaugaucgaggaacgacugaaaacauacgcccaccuauucgacgacaaaguaaugaaacaacuuaaacgccgccgcuacaccggcuggggccgccuaucccgcaaacuaauaaacggcauacgagacaaacagaguggaaaaacaauacuagacuuccuaaaaagcgacggcuucgcaaaccgcaacuucaugcaacuaauccaugacgacagccuaacauucaaagaagacauccagaaagcacaagucucgggacaaggcgauucccuccacgaacacaucgcgaaccucgccgggucacccgccauaaagaaaggaauccuacaaacagucaaaguaguagacgaacucgugaaggucaugggacgacacaagcccgaaaacauaguaaucgaaauggcacgagagaaccagacaacacagaagggccagaaaaacagccgggagcgcaugaaacgaaucgaggaggggaucaaagaacugggaucacaaauccucaaagaacacccaguugaaaacacccaacuccaaaaugaaaaacucuaccuauacuaccuccaaaacggucgcgacauguacguugaccaggaacucgacaucaaccgccuaagcgauuaugacgucgaccacaucguuccgcaaucauuccuaaaggacgacagcaucgacaacaaaguacucacccgaagcgacaaaaaucgcggcaaauccgacaacguccccuccgaagaggucgucaagaaaaugaaaaauuacuggcgacaauuacucaacgcaaaacucaucacucagaggaaauucgauaaccuaacgaaagccgaacggggaggccucuccgaacucgacaaagcaggcuuuaucaagcgacagcuagucgaaacacgacaaauaacuaagcacguggcccaaauacuagacucccgaaugaacacaaaauacgacgaaaacgacaaacucauccgcgaagugaaagucaucacgcucaaauccaagcuagucagcgacuuccgaaaagauuuccaguucuacaaggugcgugaaaucaauaauuaccaccaugcacacgacgcauauuugaacgcuguggucgggacggccuuaauaaagaaauaccccaaacuugaaagugaguucguauacggcgacuacaaaguauaugacguccguaaaaugauugccaaaagcgaacaagaaauaggaaaagcgacagcaaaauauuucuucuacagcaacaucaugaacuuuuucaagacggaaaucacgcuggcaaacggcgaaaucaggaaacggccgcucaucgaaaccaacggcgagacgggcgaaauaguaugggacaaagggcgggauuucgccacagugagaaaaguacuguccaugccacaagugaacaucgucaagaagacggaaguccaaacaggcggcuucuccaaagagucaauacugcccaaacgaaauuccgacaaacugaucgcgcggaagaaagacugggauccaaagaaauacggcggguucgacucgcccaccguggccuacucaguccucguaguagcgaagguggagaagggaaaaaguaagaaacugaaaagcguaaaagaacuucucggcaucacgaucauggagaggagcuccuucgagaaaaacccaauagacuuccucgaagcgaagggguacaaggaagucaagaaggaccucaucauuaaacugcccaaauacucgcuauucgaacuagaaaacggacgaaagcgcauguuagccuccgcgggcgaauuacagaagggcaaugaauuagcccuuccaagcaaguacgucaacuuccucuaucuugccucccauuacgaaaaacuaaaaggaucgccagaagacaacgagcaaaaacaguuauucgucgaacagcacaaacacuaucucgacgagaucaucgaacaaaucucggaguucaguaaaagaguaauccuugcagacgcaaaccuagacaagguacugucagcguacaauaaacaccgggacaagcccauccgcgaacaggcugaaaacauaauccaucucuuuacacucaccaaccucggcgccccagcagccuuuaaguacuucgacacaacuauagaccguaaacguuauacaaguaccaaagaaguccuggacgcuacccucauccaccaaucgauaacgggccucuaugaaacacgcauugacuugucucaacucggcggagacaagcgccccgccgcgacaaagaaagcaggacaggccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10347 - RNA, 5379 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcgccgaaaaagaaacgaaaaguagguauccacggagucccagccgcaaacuucaaaauccugcccauagccauagaccugggagucaaaaauacuggcgucuucuccgcauucuaccaaaaaggaacgucgcucgaaaggcuagauaacaaaaacggcaaaguauacgaacucuccaaggacuccuauacacuucucaugaacaaccgcacggcacgucggcaccagcgccgagguauagaccgcaaacaacugguuaagcgcuuguucaaacucaucuggacagaacaacucaaccuagagugggacaaagacacccaacaggccaucuccuuccuauucaaccgucgaggauucuccuucaucaccgacggguacucgccggaauaccucaacaucgucccagaacaagucaaagcaauccucauggauaucuucgacgacuacaacggugaggaugaccuggauagcuaccucaagcuggcaaccgagcaagaaucgaaaauaagcgagauauacaauaaacugaugcagaagauccuagaguucaaacucaugaagcuaugcacagacaucaaagaugacaagguaucgacgaagaccuuaaaagaaaucacgagcuacgaguucgaacuacucgccgacuaccucgccaauuacagcgaaucauugaaaacccagaaauucuccuacaccgacaaacagggcaaccucaaagaacuaucguacuaccaucaugacaaguacaacauacaagaguuccugaaaagacaugccaccaucaacgaccguauccucgacacuuuauugaccgacgaccucgacaucuggaauuucaauuucgagaaauuugacuucgacaaaaaugaagaaaagcugcagaaucaggaagacaaagaccacauacaagcucaucugcaccacuucgucuucgcagucaauaagaucaaguccgagauggcaucaggcggccgacaccgcagccaauauuuccaagagaucaccaacguccuagaugaaaacaaccaccaagagggauaccucaaaaacuucugcgaaaaucuacacaacaaaaaguacuccaaucugagcgucaaaaaccucgucaaccucauaggcaaccucucgaaccuagagcucaaaccccuccgcaaguauuucaacgacaagauucacgccaaggcagaccacugggacgagcaaaaguucacagaaaccuacugucauuggaucuuaggagaguggagagucggcgugaaggaucaagacaaaaaggacggugccaaauacuccuacaaggaccucuguaacgagcugaaacaaaagguaaccaaggccggccugguagacuuucuacucgaacuugacccaugucgcacgauacccccauaucucgacaacaacaaccgcaagccgcccaaaugccaaucguuaauccucaaccccaaguuucuagacaaucaauaccccaacuggcagcaguaccuacaggaacuuaagaaacuccaauccauacaaaacuaccucgacuccuuugaaaccgaccugaaaguccuaaaaagcaguaaggaucaacccuacuucgucgaauauaaauccagcaaccaacaaaucgcauccggacaacgagacuauaaggaccuagacgcacguauccuccaauucauuuucgauaggguaaaggcuuccgacgaacuacuacuaaacgagaucuauuuccaagcaaagaaacugaaacagaaggccucgagcgagcuagaaaaacuggaauccagcaagaagcuggacgaagugaucgcaaacucccagcucucgcaaauauuaaagucccaacacaccaacggaaucuucgaacaagguacuuuccuucaccuaguaugcaaguauuacaagcaacgacaacgcgcaagggauucacgccucuacaucaugcccgaguaccgcuacgauaaaaagcugcacaaguauaacaacaccggccgcuucgacgacgacaaccagcuacucacuuacugcaaccacaaaccgagacagaaacgcuaccaacuucucaacgaccucgccgggguuuugcagguauccccaaacuuccuaaaagacaagaucggguccgacgacgaccuuuucaucucaaaguggcucguagagcacauccgagguuucaaaaaggcgugcgaggacucgcuaaaaauacaaaaggacaaccgcggccuacucaaucauaaaauaaauaucgcccguaauacgaagggcaaaugcgaaaaggaaaucuucaaccugaucugcaaaauagagggcuccgaagauaagaaaggcaacuacaaacacggacucgccuacgaguugggcguccuacuauucggcgagcccaacgaagcaucaaagccagaguucgaccgcaagaucaaaaaguucaauucaauauacuccuuugcacaaauacaacagaucgccuucgccgaacguaagggaaacgcgaauacuugcgccgugugcucagcagauaacgcccaucgcaugcagcagauaaaaaucaccgagccuguugaggacaacaaagacaagauaauacuaagcgcgaaagcccagcgccuucccgccauaccaacccgcauagucgacggggccgucaagaaaauggcaacgauccucgcuaaaaacaucguagacgacaacuggcagaacauaaaacaaguucuaagcgcaaaacaccaacuucacauucccaucauaaccgaaucgaacgcguucgaguucgagccagcacuggcagacguuaaaggaaagagccuuaaggaucgaagaaagaaagcccucgaacgaauaagucccgagaacaucuucaaggacaaaaauaaucguauaaaagaauuugcgaaaggcauaucagccuacagcggcgccaaccuaaccgacggcgacuuugacggcgccaaagaggaacucgaccacauaauacccagaagccacaagaaauauggcacgcugaaugacgaggcgaaccuaaucugcguaaccagaggcgauaauaaaaacaagggaaaccgaaucuucugucugcgagaucucgccgauaacuacaaacucaagcaauuugaaaccacggacgacuuagagaucgaaaagaaaauagcagacacuaucugggacgccaacaagaaagacuucaaauucggaaacuaucgcagcuucaucaaucuaacgccgcaagaacaaaaagcauuccgacacgcccucuuccucgccgaugaaaauccaaucaaacaagccguaauacgcgcuaucaacaaccgaaaccgaaccuucgucaacggcacccaacgcuacuuugccgaaguacucgcaaacaacaucuaccugcgagccaaaaaggagaaccuaaacacagauaagaucuccuuugacuacuucggcauacccacaaucggaaacggacgaggcaucgcugagauccgccaacuauacgagaaagucgacagcgacauccaagcauacgccaaaggugacaaaccucaggccagcuacucucaccucaucgacgccaugcuugcguucugcaucgcggcggacgagcaccgaaacgaugguuccaucggccuagaaaucgacaaaaacuacagccuguacccacuagacaaaaacaccggagaaguuuuuaccaaagacauauuuagccaaaucaagauuaccgauaacgaguucagugacaagaagcuaguucggaaaaaggcuaucgaaggcuuuaacacgcacagacaaaugacccgcgacggcaucuacgccgaaaacuaccuccccauccuuauccacaaggaacucaacgagguacggaaaggcuauacguggaaaaacucggaggaaaucaagaucuucaaaggcaagaaauacgacauucaacaacucaacaaucucgucuauugccucaaauucgucgauaaaccgauuagcauagacauccaaaucucaacccuggaggaacuccgcaacaucuuaacaacgaacaacauugcggcgaccgccgaguauuacuacaucaaccucaagacacagaaacuucacgaguacuacaucgaaaacuacaacaccgcacuaggcuauaaaaaguacuccaaggaaauggaauuucuaagaucccucgccuaccgaucagaaagagucaaaaucaaaucaauugacgacgucaagcaaguucuagacaaagacagcaacuucaucaucgggaagaucacgcuucccuucaagaaagaauggcagcgccucuacagagaauggcaaaacaccacaaucaaagaugacuacgaguuccuuaaaucauucuucaacguaaaaagcauaacaaaacuucauaaaaagguaaggaaggauuucucacuccccaucuccacaaacgaaggcaaguuccuugucaaacgcaagacaugggacaacaacuucauauaccaaauccuaaacgauagcgacuccagagcugacggcacaaagccauucauaccggcauuugacaucucaaagaacgaaauagucgaagcaaucauugacagcuucacaaguaaaaacaucuuuuggcuuccaaagaacauagagcugcaaaaaguagacaacaaaaacaucuucgccauugacacgagcaaaugguucgaaguggaaacgcccucugaccuaagagauauagggaucgcaacaauccaauacaagauagauaacaacagccgaccaaaaguaagaguaaaacucgacuacgucaucgacgacgauaguaaaauaaacuacuuuaugaaccauucccugcuaaaaucccgauacccggacaaaguccuggaaaucuugaaacaguccacuaucaucgaguucgaaaguuccggauucaacaagaccauaaaggaaaugcugggcaugaaacucgccgguauuuacaacgaaaccagcaacaauaagaggccagccgccaccaagaaggccggccaggcgaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10348 - RNA, 3651 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaaaaagaaacggaaggugggcauacacggcguccccgcagcaaaaagaaacuacauccuagggcuagauauaggcaucaccuccgucggcuacggcauaauagacuacgaaacaagggaugucaucgacgcggggguacgccuauucaaagaagcaaacgucgagaacaacgaaggacgcaggucaaaacgaggagcacggcgacugaagcgacgcagacgacaccgcauccaacgggucaagaagcucuuauucgacuacaaccugcuaacggaccacucggaacugucuggcaucaaccccuacgaggcccgagucaaaggacucagccaaaaacuauccgaagaagaguucuccgcagccuuacugcaccuggcaaagagacgcgguguacacaacguaaacgaggucgaggaagauaccgggaacgagcuauccacaaaggaacagaucagcaggaacagcaaagcacucgaggagaaauacguagcggaacuccagcucgaacgacucaaaaaggacggcgaaguccguggcuccauaaaccgauucaagacaucggacuacguuaaggaggccaagcaacuccuaaaaguccaaaaagccuaccaccaacuagaccagagcuuuaucgacacguacauugaucuacucgagacgcgaaggaccuacuacgaaggcccgggagaaggcaguccauucggguggaaagacaucaaagagugguacgaaaugcucauggggcacugcaccuacuucccagaagaacugcgcucagucaaguacgcuuacaacgccgaccucuacaacgccuugaacgaucuaaacaaccucguuauaacccgagacgagaacgagaaauuggaauacuacgagaaguuccaaauaauagaaaacguauucaaacagaaaaagaaaccgacccuaaaacaaaucgccaaagagauccuggucaaugaggaagacauaaaaggguaccgcguaaccuccacgggcaagccagaguucacgaaccucaaagucuaccacgauaucaaggacaucaccgcacggaaggaaaucauagaaaacgccgaacuacucgaucaaaucgccaaaauacucaccaucuaccaaagcucggaggacauacaagaagaacuuaccaaccuaaacucugaauuaacgcaagaggagaucgagcaaauaucaaaccucaaaggcuacaccggcacacacaaucucucgcucaaggcaauaaaccucauccuggaugaacuauggcacacgaacgauaaccaaauagccaucuucaaccgccucaagcuggucccgaagaaagucgaccuaucgcaacaaaaagagaucccaaccacacucguagacgacuucauacucucgccagugguuaaacgcucguucauccaauccaucaaagucaucaacgccaucaucaaaaaguacggccuaccaaacgacaucaucauugagcuagcccgcgagaaaaacuccaaagaugcgcagaaaaugaucaacgaaaugcagaaacggaacagacaaacgaacgaaagaaucgaagagauaauacgcaccaccggcaaagaaaacgcaaaauaccucauagagaaaaucaagcuccaugacaugcaagaaggaaagugccuauacucguuggaagccaucccccuggaagaucuacuuaacaaccccuucaacuacgaagucgaccacaucaucccgcgaucagucucauucgacaacagcuucaacaacaagguccuaguaaaacaagaagaaaacuccaagaaaggcaaccgcacccccuuccaauaccuaaguagcucagacucaaaaaucagcuacgaaacguucaagaaacacauacucaaccuugcgaaaggcaaaggacguauaagcaaaacuaaaaaggaauaccuacuagaggaaagagacaucaaccgauucagcguacagaaagacuucauaaaucggaaccucgucgacacccgauacgcaacccgcggccucaugaaccugcugcgaucauauuucagggucaauaaccucgacguaaaggucaaguccaucaacgguggguucacuucauuccuucgcagaaaauggaaauucaaaaaggaacgcaacaaaggcuacaaacaccacgccgaagacgcccugauaauugcaaacgcagacuucaucuuuaaagaauggaaaaagcuagacaaggcaaagaaagucauggaaaaccaaauguucgaagaaaaacaagcagaguccaugcccgaaauagagacggagcaagaauacaaagaaaucuucaucacaccccaccaaauaaaacauauaaaagacuuuaaagacuacaaguauucgcauagaguagauaagaaacccaaccgagagcucaucaacgacacccucuacucgacccgcaaagacgacaagggcaacacgcucauagucaacaaccuaaacgggcucuaugacaaggacaacgacaaacucaagaaacucaucaacaaguccccagagaaacuccucauguaccaccacgacccgcagaccuaccaaaaacucaaacucaucauggaacaauauggggacgagaagaacccccucuacaaauacuaugaggaaaccggcaauuaccucacgaaauacucaaagaaagacaacggacccgucauaaagaaaaucaaauauuacggaaauaaacucaacgcacaccucgauauaaccgacgacuacccuaacucacgcaacaaagucguaaaauuaucacucaaaccguaccgcuuugacguauaccuggacaacggagucuacaaauucguaaccguaaagaaccucgacguaauaaagaaggagaacuacuacgaagucaacuccaaaugcuacgaggaggcaaagaaacucaaaaagauaucaaaccaggccgaguuuauagcuuccuucuacaacaacgaucugauaaagaucaacggagaacucuaccgcguaaucggcguaaacaacgaccugcuuaauagaauugaggugaacaugauagacaucacauaccgcgaauaccuggaaaacaugaacgacaaacgcccgccccgcauaaucaaaaccauagccagcaaaacccaauccauuaagaaguacaguacggacauacucggcaaucucuacgaaguaaaaagcaagaaacacccccaaaucaucaagaaaggcaaacgacccgccgcaacuaagaaagcaggccaggccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10349 - RNA, 4719 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggccccuaaaaagaaaagaaaagucggcauacauggagugccagcggcccuauucaacaaauguauaaucauuuccauaaaccuggauuucuccaacaaagaaaaaugcaugacaaaaccuuacuccaucggacuggacaucgggacaaacucgguagggugggcuguaaucaccgacaacuacaaaguaccaagcaagaaaaugaaaguccuagggaauaccagcaagaaauauaucaagaaaaaccuucugggcguccuccuguucgacuccgguauuaccgccgaagggcgaaggcuuaaacgcacugcgcgccgccgcuacacgcgcagacgaaaucgaauacucuaccuccaggaaaucuucuccacagaaauggcaacacucgacgacgcauuuuuccaacgccucgaugacaguuuucuagugccggacgacaaacgugacagcaaauacccaaucuucggcaacuugguggaagaaaaagucuaccacgacgaguucccuacgauauaucaccucagaaaauaccucgccgacuccacuaagaaagccgacuuaagacucgucuacuuggcacuagcccacaugauuaaauacagagggcacuuccucaucgaaggagaguucaauuccaaaaacaacgacauacagaaaaacuuccaggacuuccuggacaccuacaacgccaucuucgaaucugaucucucacuggaaaacucaaaacaacucgaagaaaucgucaaggacaaaauaagcaaacuagaaaagaaagaccggauccucaaacuuuucccuggugagaaaaacagcgggauauucuccgaguuccucaaacuuauaguugguaaccaggccgacuucagaaaaugcuucaaccuagacgaaaaagcguccuuacacuucucgaaagaauccuacgacgaagaccuggaaacccugcucggauacaucggagacgacuacuccgaugucuuccugaaagccaagaaauuauaugaugcaauccugcucuccggcuuccuaaccguaaccgacaacgaaacugaagcgccucuuucuuccgccaugauaaagcgcuacaacgaacauaaagaagaccucgcgcuccugaaggaauacaucagaaacauaagucugaaaacuuacaacgaagucuucaaagacgacacuaaaaacggguacgcaggauauaucgacggaaaaacuaaccaagaagacuucuacgucuaucucaaaaaccuccuagcagaguucgaaggagccgauuacuuucucgaaaagauugaccgagaagauuuucuacgcaaacaacguacauucgauaauggaucaaucccguaucaaauacaccuacaagaaaugcgcgccaucuuagacaaacaggccaaguucuacccguuccuggcuaaaaacaaagaacgaauagagaaaauccugaccuuucggauucccuacuaugucggcccccuagcgcggggaaauucugacuuugccugguccauacgcaaacgcaacgagaaaaucacccccuggaacuucgaagacgucaucgacaaagaguccagcgccgaggcauucauaaauaggaugacauccuucgaccuauaccucccagaggagaaaguccucccaaaacacucccuccuauacgaaacauucaacgucuacaacgaacucacaaaaguucguuucaucgccgagucgaugagagacuaccaauuccuagacucaaaacaaaagaaagacauagucaggcuuuacuucaaagacaagcggaaagucaccgauaaagacaucaucgaguaccuccacgcgaucuauggcuacgacggcaucgagcuaaagggaaucgaaaagcaguucaacagcucgcuaucgaccuaccacgaccuauugaacauaauaaacgacaaagaguuccuagaugauuccagcaacgaggcgauaaucgaagaaaucauccacacccugaccauuuuugaggaccgcgaaaugauaaagcagcgccucuccaaguucgagaacaucuucgauaagucgguccuuaagaaacuuucccgccgccacuauaccggcugggguaaacuauccgccaaacuaaucaacggcauaagagaugaaaaauccggcaauacaauacucgauuaccucaucgacgacgguauaucaaaccgaaacuucaugcagcucauacacgacgacgcccuuuccuucaagaagaaaauucagaaagcccagaucauuggggacgaagacaaagggaacauaaaagaggucguaaagucacugccaggaucccccgcuaucaagaaggggauauuacaauccaucaagaucgucgacgagcuagugaagguuaugggcggacgcaaacccgaaucaaucguugucgaaauggcccgugaaaaccaauacacgaaccaagggaaaucgaacucacagcagcggcuaaaaaggcuggagaaaucccuuaaggagcuaggcuccaaaauccugaaagagaacauccccgcaaagcuauccaaaauagacaacaacgcgcuccaaaacgaccgccuauaccucuacuaccuacaaaacgguaaagacauguacacaggggacgaccuggacauagaucgacucucaaacuacgacaucgaccauaucaucccccaagcauuccuaaaggacaauucgauagacaacaaagugcucgucucuucggccuccaaucgagggaaaagcgacgacuuccccucccuagaagucgucaagaagcggaaaacguucugguaccagcuccuuaagucaaaacucauaagccaacgcaaguuugacaaccucacgaaagcagaacguggaggucuccuaccagaagacaaagccggcuuuauccagagacaacucguugaaaccagacaaaucaccaagcacgucgcgcggcuucuagacgaaaaauucaacaacaagaaagacgaaaacaaccgagcugugcgcacagucaaaaucaucacccuaaaguccacgcucguuagccaauuccgcaaggacuucgagcuguauaagguccgcgaaauaaacgacuuccaccacgcgcaugacgcauaccuaaaugcuguuauagcguccgcacuucuaaagaaauaucccaaacucgagcccgaguucgucuacggagacuacccgaaauacaacuccuuccgcgaacgcaaaagcgcaaccgaaaagguauacuucuacuccaauauaaugaacaucuuuaaaaaguccaucucucuagccgacggacgugugaucgaacggccccucaucgaagucaacgaggaaacgggcgaaucggucuggaauaaggagagcgaccuagcgacgguccgacgcguccucagcuacccccaagucaacguggucaagaaagucgaggaacaaaaccaugggcucgaucgcggcaaaccuaaaggacuguucaacgccaaccucucgagcaagccgaaaccuaacuccaacgagaaccuggucggugcgaaagaguaccuggaucccaagaaauacgguggguacgcgggaaucaguaauuccuuugcuguccuaguaaaaggcaccauagaaaaaggggccaaaaagaaaaucaccaacgugcuugaguuccaggggaucaguauccuagacagaaucaacuaccgcaaagacaagcucaacuuccuucucgaaaaaggcuacaaggacauagaacuaaucauagaacuaccaaaauauagucuauuugaacuaagcgacggcagccgacggauguuagcaucgauccucagcacuaacaacaaaagaggggaaauccacaaaggcaaccagaucuuucuaucacaaaaguucgugaaauuacuauaccacgccaaaagaauaucgaauacgaucaaugaaaaccaccgaaaauacgucgagaaccauaagaaggaguucgaggagcucuuuuacuacauccuagaguucaacgaaaacuacgucggcgccaagaaaaacggaaaacuccuaaacucggcauuccaaaguuggcagaaccauucgauagacgaacuuugcagcagcuucaucggcccaaccgggagcgaacgcaagggccuauucgagcuaacaucacgcggguccgccgcggacuucgaguucuugggugucaaaauaccaagauaccgagacuacacccccagcucucuucucaaagacgccacccucauccaccaaucggugaccgggcucuacgaaacccgcauagaccuggcaaagcuaggcgaagggaaacgccccgcggccacuaagaaagccggacaggcaaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10350 - RNA, 3795 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcacccaaaaagaaaagaaaaguuggaauccacggaguacccgcggcaugguacgcaagccucaugucugcccaccaccuaagaguagguauagacguuggcacccacucugucggacuagccacccuacgagucgaugaccacggaaccccaauagaacugcuaagcgcacuuucgcauauccacgacucaggagugggcaaagaaggcaagaaagaccacgacaccagaaagaaauuaagcggaauugcccggcgggcacgccggcuacuacaccaccgaagaacacagcuccagcagcucgacgagguccugcgagaccuaggauucccaauacccacaccaggggaguuccuagacuuaaacgaacaaaccgacccauaccgaguauggaggguaagagcacgccuaguagaagagaaacuacccgaagaacugcguggaccugcaaucucaauggcgguuaggcauauagcccgacacagaggauggaggaaccccuacuccaaaguagaaucacuccuaagcccagccgaagagagccccuuuaugaaagcccuaagagaacgcauccuggcaacuaccggcgaaguacucgacgauggcaucacacccggccaagcaauggcccaaguagcccucacucacaacauaucgaugcgcggaccagaaggcauauuaggcaaacuacaccagagcgauaacgcaaacgaaauacgaaaaauaugcgcccgccaaggcguaucccccgauguauguaaacaacuucuccgggcgguauuuaaagccgacagcccaagaggaucagcagucucaagggucgcgcccgauccccucccaggccaagggaguuuccgccgagcaccaaaaugcgacccagaguuccaacgcuuuagaauaauaucaauagucgcaaaccucaggauaucggaaaccaaaggcgaaaacaggccguugacagcagacgaacggaggcacgucgugacauuccuaacagaggacucccaggcagaccuuaccuggguagacgucgcugaaaaacuagggguacaucgucgugaccucagagggacagcgguucauaccgacgacggagagaggucagccgcccgacccccgaucgacgccaccgacagaaucaugagacaaacuaaaauauccagccuaaaaaccuggugggaagaagccgacucggaacaacgaggcgccaugauacgguaccuauacgaagacccaaccgacuccgaaugugccgaaaucauugcagaacuaccggaggaagaccaagccaaacuagacagccuccaccuuccagccgggcgcgcggcauacucacgugagagccuaaccgcccucucagaucacaugcuugcaaccaccgacgaccuucaugaagcgaggaaaagacuauucggaguggaugacagcugggccccaccggccgaagccaucaacgcaccagucgguaaccccucaguagaccggacacucaaaauaguaggaagauaccucuccgcaguagaaagcauguggggaacacccgagguaauccacguagaacacguaagagacggcuucacaagcgagcgcauggccgacgaaagagacaaggcaaaccgcaggagauauaacgacaaccaagaggccaugaagaaaauccaacgggacuauggaaaagaaggauacaucagcagaggcgacauagugcgacucgacgcacuagaacuccaaggaugcgcaugccuuuauugcggaacuacaaucggauaucacacaugccaacuugaccacauaguaccacaagccggcccggggucuaauaaccgaagaggaaaccuaguggcgguaugugaaagauguaaccgauccaaauccaacacacccuucgccgucugggcacagaaaugcggaaucccacacguaggagucaaagaggcgauaggacgagugagaggcuggcgaaaacaaacgcccaacaccucgagcgaagaccuaacaagguuaaagaaagaaguuaucgccaggcuaaggagaacccaagaagacccggagauagacgaacgaucuauggagagcguagcauggauggcaaaugagcuucaccaucggauugcugcugcguacccagaaacaaccgugaugguauacagaggaucgaucacagccgcagcacggaaagccgccgggauagauuccagaauuaaccuaauuggcgagaaaggcaggaaagacaggauagacaggcgccaccacgccguagacgccagcgucgucgcccucauggaagccagcgucgcaaaaacccuagcagaaaggucaucccuccgcggcgaacagcgccugaccggcaaagaacagacguggaaacaguauacaggaucgacagugggggcacgagaacacuucgaaauguggcgcgggcacaugcuacaccuuacggaacuguucaacgagcgacucgcagaagacaaaguauacguuacccagaacauacgacuacgauugucagacggaaacgcccacacgguaaacccaucaaaacuggugucucaccgucuuggcgacggacucaccguacagcaaaucgacagagccugcacgcccgcccuauggugcgcccuaaccagagagaaagacuuugaugagaaaaacggacuaccggcacgagaagacagggccauaagaguacacggccacgaaaucaaaaguagcgacuacauacagguauucaguaaacggaaaaagaccgacucggaccgagacgagacgcccuucggcgccaucgcaguuagaggcggauucgucgaaaucggcccauccauccaucacgcacgaauauacaggguagaaggaaagaaacccgucuacgcaaugcuuagaguauucacccacgaccuacuaagccaacgacacggagaucucuucagcgcaguaauaccaccacaauccauaagcaugcgaugugcggaaccaaagcugagaaaagccauaaccacaggcaaugccacauaccucggauggguaguuguaggcgacgaacuggaaaucaaugucgacaguuucacgaaauacgccaucgggcgauuccuagaggacuucccaaacacuacuagguggcgaauaugcggguacgacacaaacucgaaacucacccuuaaaccaauuguacucgccgccgaagggcucgaaaacccgucuuccgcggucaacgaaauuguagaacuaaaaggauggcgaguggccauaaacgugcuaaccaaaguacacccaacggugguacgccgagacgcacuaggaaggccacgauacagcucucgcucuaaccuccccacgucauggaccauagaaaaacgccccgccgcuaccaaaaaggccggacaggcgaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10351 - RNA, 4656 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaaaaaaaaacgaaaaguaggcauccacggcgucccggcagcuacaaaacccuacuccauuggccuggacauaggaacaaacuccgucggcugggcaguaaccacggauaauuacaaagucccaucgaaaaagaugaaaguacuggguaacaccagcaagaaguauaucaaaaaaaaccugcuggggguacugcucuucgacucgggcauaaccgcugaggggcgaagacucaaacgcacggcccggcgccgauauacgcgacgacgcaaccgcauacucuaccugcaagagaucuucuccacagaaauggcaacgcuggacgacgcguucuuccaacgacuagaugacagcuuccucgugcccgacgacaagcgcgacucaaaguaucccauauucggcaaccucgucgaagaaaaggcauaucacgacgaauuccccacaauauaucaucugcgaaaauaccucgccgauucuacaaagaaagcggacuuacgacucguguaucuggcgcuggcccacaugaucaaauacaggggacacuuccugauagaaggcgaguucaacagcaagaacaacgacauacaaaaaaauuuccaagacuuccucgacacauacaaugcaauuuucgaaagcgaccucagccucgagaacagcaaacagcuggaggagaucguaaaggacaagauuuccaaacuagagaaaaaagacagaauccuuaaacuauuccccggagaaaagaacagcgggaucuucagcgaauuccucaaacugauuguuggcaaccaagcggacuuccgcaaaugcuucaaccuggacgaaaaagcuagccuccacuucuccaaagaauccuaugacgaagaccuggaaacacuacucgguuacauaggagacgacuacuccgacguauucuuaaaggccaaaaaacucuacgacgcaauacugcuguccggcuuccuaaccgucaccgacaacgaaaccgaagcaccacugagcucugcaaugaucaaacgauacaacgagcacaaggaggaccuagcacuacucaaggaauauauccguaacauaagccuuaaaacauacaacgaggucuucaaggacgacaccaaaaacggcuacgcgggguacaucgacggaaagaccaaccaggaagacuucuacguauaccuaaaaaagcuccucgcggaauuugaaggggcagacuacuucuuagaaaaaauagacagagaggacuuccuccguaaacaacgaacauucgacaauggcuccauacccuaccaaauucaucuacaagaaaugcgcgccauccuugacaagcaagcgaaguucuaccccuuccuugcaaaaaacaaagaacgcaucgaaaagauccuaacauuccgaauuccauacuacguagggccccuagcucgggggaacuccgacuucgcaugguccaucagaaagcgcaacgaaaaaauaacuccuuggaauuucgaggacgucauugacaaggagucuuccgccgaagccuucauaaaccgcaugacauccuuugaccucuaccuaccagaggagaaagugcuaccgaagcauagccuccuauacgaaacauucaacguauauaacgaacuaaccaagguccgauucauagcagagucaaugcgagacuaccaauuccuugauaguaaacaaaaaaaagacaucguucgccuauacuucaaggacaagcguaagguaaccgacaaagacaucauagaauaucuccacgcgaucuacgguuacgacggcauagaacuuaaggguauagagaagcaguucaacaguucacucuccacuuaccacgaccuccugaacaucaucaaugacaaagaguuccuagacgacagcuccaacgaggccauuauagaagaaaucauacacacccuaacuaucuuugaagacagggaaaugaucaaacaacgccuuagcaaguucgaaaauaucuucgacaaauccguccugaaaaagcuaucucggagacacuacaccggcuggggcaaacucuccgcaaagcugaucaacgggauccgcgacgagaaguccggcaacacaauccucgauuaucuaaucgaugaugggaucagcaauagaaacuucaugcaacugauucaugacgaugcacucagcuucaaaaaaaaaauacaaaaagcacaaauuaucggagacgaggacaaagggaacaucaaggaaguaguaaagucacucccaggaucaccagcgaucaaaaaagggaucuuacaauccaucaaaauagucgacgaacuugucaaagucauggggggccgcaagccagaaucgauaguagucgaaauggcccgugaaaaucaauacaccaaccaaggcaagagcaauagccaacagagacucaaacgccuagaaaagagccucaaagaacucgguaguaagauccugaaggaaaacauacccgccaagcuaaguaaaauagacaacaacgcacuccaaaacgacagacuguaccuauacuaccugcagaacgguaaagacauguacacgggagacgaccuggacaucgacaggcucagcaacuaugacaucgaccacauaauuccgcaagcauuucuaaaagacaauagcauagacaacaaagucuuaguaucaucagcgagcaacagaggaaagagugacgaugucccaucccuagagguggugaaaaagcgaaaaaccuucugguaccaacuacucaaguccaagcuuaucucacagcggaaguucgacaaccucacuaaggccgaaagagggggucuaucccccgaggacaaagccggguuuauacaacgccagcucguagaaaccagacaaaucacgaaacacguagcgcgucuccucgacgaaaaauuuaacaacaaaaaggacgaaaacaacagggcaguaagaaccgugaaaaucaucacccugaaguccacccuggucucccaguuccgcaaggauuucgagcuuuauaaaguaagagaaauaaacgacuuccaccaugcacacgaugccuacuuaaacgccgucgucgccuccgcacugcuaaaaaaguacccgaagcuggaacccgaguucgucuacggugauuauccuaaauacaauuccuuccgugaaaggaaguccgcaacggaaaaagucuacuucuauuccaacauaaugaacauauucaaaaaauccauuucacucgcggacggacgaguuauagaacgaccacucaucgaagucaacgaagaaaccggugagagcguauggaacaaagaauccgaccucgccaccguacgacggguacucucguauccucaaguaaacgucguuaaaaaggucgaagagcaaaaccacggucucgaccgcggcaaaccuaaagggcuuuuuaacgccaaccucucguccaagccuaaacccaacucuaacgaaaaccucgucggcgcaaaagaauaucucgaccccaagaaauacggcggauacgcugggauaucaaacuccuucacaguacugguuaagggcacuaucgaaaaaggagccaaaaaaaaaauaacgaacguccucgaauuccagggaauuuccauacucgaccggaucaacuaccggaaagacaagcugaacuuccucuuagaaaagggguacaaggacaucgaacuuauaaucgagcugccgaaguacucccucuucgaacugagugacggcagccgccgcaugcuugccaguauccuauccaccaacaacaagcgcggcgaaauucauaaaggcaaccaaauauuccucagccaaaaguucgucaagcuauuguaucacgccaaacguaucucuaacaccaucaacgaaaaccaccgaaaguacguagaaaaccacaaaaaagaauucgaagaacuauuuuacuacauucucgaauucaacgaaaacuacguaggcgcgaaaaagaacggcaagcuacuuaacuccgccuuucaauccuggcagaaccacagcauagacgaacugugcagcagcuucaucggccccaccggcuccgaacgaaaggggcucuuugaacuaacaagcagaggaucagccgccgacuucgaauuccucgggguaaaaauaccgcgcuaccgagauuacaccccaagcucauugcuaaaagacgccacucugauacaccaaaguguaacagggcuauacgaaacgagaaucgaccuagcaaaacucggcgagggcaaacgacccgcagccaccaaaaaagcuggccaagcuaaaaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10352 - RNA, 3738 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccgaaaaagaaacgaaaagucggcauccacggaguaccagccgccgccgccuucaaacccaacucaaucaacuacauccuaggccuggacauaggcaucgccagcgucggaugggccauggucgagaucgacgaggaggagaaccccauccgccuaaucgaccugggaguccggguauucgaaagagcagaaguccccaaaaccggcgacucacuagcgauggccagaaggcuagcccgcagcguaagacggcuaacaaggcgcagggcccaccggcuacuccgcacacggcgacuacucaaacgagagggcguccuccaagcagccaacuucgacgaaaacggccucaucaaaucccucccuaacacucccuggcaacuccgggcagcagcucucgaccgcaaacucacaccacuagaauggagugcaguucuccuccaccuuaucaaacaccgcgguuaccucucccaacggaaaaacgaaggcgaaacagcagacaaagaacuaggcgcucuccugaaagggguggccgggaaugcgcacgcccuccaaaccggcgacuuucggacacccgcagagcucgcacuaaacaaauucgaaaaagaaucaggccauauaagaaaccaaagauccgacuacucacacacauuuagccgcaaagaccuccaagccgagcugauucuacucuucgaaaaacaaaaagaguuuggaaacccccacguauccgggggccuaaaagaaggaaucgaaacccuccucaugacccaaaggcccgcucugucgggggacgccguacaaaagaugcuuggccauugcacguucgaaccagcugaaccaaaggcggcuaaaaacacauacacggccgaaagauuuauauggcuaacaaagcuaaacaaccuccgcauacuagaacaaggcagcgaaagaccacuuacagauacagaaagagcuacccucauggacgaaccauacagaaaguccaagcugaccuaugcccaggcgcgaaaacugcucggacucgaagacacagcauuuuucaagggccuacgcuacggcaaggacaaugccgaagccaguacccucauggaaaugaaagccuaccacgcaaucucccgcgcacucgaaaaggaaggacugaaagacaagaaaucaccccucaaccuaucacccgaacuccaggacgagaucggaaccgcauucucacuguucaaaacagaugaggacaucaccggccgacugaaagaccgaauccaaccggagauacucgaagcccucuuaaaacacaucucguucgacaaauuuguacagaucucccucaaagcacuucggaggauagugccccuuauggagcaagggaagcgcuacgacgaggcaugcgcggaaaucuacggggaucacuacgggaagaaaaacacagaagagaaaaucuaccucccaccaauaccggccgacgaaauccgaaaccccgucguccucagagcgcuaucacaagcccgaaaagucaucaacgggguaguccguagauacggcucaccggcccgcauacacaucgaaacagcccgcgaaguugguaaauccuucaaagaccggaaagagauugaaaaacgacaagaagaaaaccgcaaagaccgcgaaaaagcggccgcgaaauuccgugaguacuucccaaacuucguaggagaacccaaauccaaagacauccuaaaacuccgccuguacgaacaacaacacggaaaaugccuguacuccggaaaagaaauaaacuugggacgacucaacgaaaaaggcuacgucgaaaucgaccaugcccuacccuucucucgaaccugggacgacucauucaacaacaagguacugguucuaggcagcgaaaaccagaacaaaggcaaccagacacccuacgaauacuucaacggaaaagacaacucccgcgaauggcaggaguucaaagccaggguagaaacaagccgauucccccgaucgaagaaacaaagaauacuccugcaaaaauucgacgaagacggguuuaaagaaagaaaccucaacgacacccguuacguaaaccgguuccugugccaauucguugccgaccgaaugcgcuuaaccggaaaggggaagaaacgcguauucgcaagcaacggccaaauaaccaaccuccugcggggauucuggggacuucgaaaaguccgcgcagaaaacgacagacaccacgcccuagacgccgucguugucgcuugcagcacgguagccaugcaacaaaagaucacgcgguucguacgauacaaagagaugaacgcauucgacggcaaaacaauagacaaagagacaggugaagucuugcaccagaaaacccacuucccucaaccuugggaguucuucgcucaagaaguaaugauacggguauucgggaagccugacgguaaacccgaguucgaagaagcagacacgcuagaaaaacugcgaacccuccucgcggaaaaacuuucaaguagaccugaagcaguccaugaguacgucacgccccucuuugucuccagagcgccaaacaggaaaaugagcggacaaggacacauggaaacgguaaaauccgcuaaacgccucgaugaaggggucucaguccuccgugucccccuaacgcaauuaaagcucaaagaccucgagaaaauggucaaucgcgaacgagaaccaaagcuauacgaagcccugaaagcaagacuggaagcccacaaagacgaccccgccaaggcauucgcugaaccauucuacaaguacgauaaggcggggaaucgaacgcaacaagucaaagcaguccggguggaacaaguccagaaaacuggcgucuggguacgcaaccacaacggcaucgccgacaacgcgaccauggugcggguagacgucuucgagaaaggggacaaauacuaccuagucccaaucuauagcuggcaagucgcaaaaggaauccuaccagaccgcgcagucguccaaggcaaggacgaggaggacuggcaauuaauugacgacagcuuuaacuucaaauucagccuccacccgaacgaccucguggagguaaucacuaaaaaggcacgaauguucggauacuuugcgagcugccaccgcggaacgggaaacaucaauauacggauccacgaccucgaccacaaaaucgggaaaaaugggauacucgaaggcauaggcguaaaaacagcccucagcuuccaaaaguaccaaaucgacgaauuggggaaagaaauccggccgugccgccuaaagaaacggccgccaguccgaaaacgcccagccgcaaccaaaaaggccgggcaagcaaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10353 - RNA, 4494 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaaaaagaaaagaaaagucgguauccacggaguccccgcggcgaagaaacccuauacgauagggcuagacaucgggacaaauucaguugguugggcagugcucacggaccaguacgaccucgucaaaagaaaaaugaaaauagccggagacucagaaaagaaacagauaaagaaaaacuuuuggggaguacgucucuucgacgaagggcaaaccgcagcggacaggcgaauggcgcgcacagcacggcggcgcaucgaacggcgacgcaaccggaucagcuaccugcaagggaucuucgcggaagaaauguccaaaacggacgcgaacuucuuuugccggcugagcgauagcuuuuacgucgacaacgagaaaaggaauagccgccacccauucuucgcgaccaucgaggaagaagucgaauaccacaaaaacuauccaacuaucuaccaucugcgggaagaacucguuaauuccagcgaaaaagcugaccuacgccuagucuaccucgcgcuagcccacaucaucaaauaccggggcaacuuucucaucgagggcgcgcuagauacccagaacaccuccguggacggcaucuauaaacaauucauccagacauauaaucaagucuuugcaucaggcauagaggacggcagucucaagaaacuugaggauaacaaagacgucgccaaaauacucguggagaaagucacgcguaaagaaaagcuagaaaggauccucaaacuauacccuggggaaaaauccgccggcauguuugcccaauucaucucgcuaauugugggcagcaaagggaacuuccaaaaaccguucgaccugauagagaaaagcgacauagagugcgcgaaagacuccuacgaggaagaccucgaaucacuacuagcucuaaucggggacgaauacgcagaacucuucguggccgccaaaaacgcauacucagcaguaguccuaagcuccauuaucacggucgccgagacagaaacgaacgccaaacucagcgccucgaugaucgagcguuucgacacucacgaagaggaccucggcgagcuaaaggcauucaucaagcugcaccucccgaaacacuacgaggagauauucagcaauaccgaaaaacacggcuacgcgggcuacaucgauggaaaaacaaagcaagccgacuuuuauaaauacaugaagaugacgcucgaaaacaucgagggcgcagacuacuucaucgccaagauagaaaaagagaacuuccuacgcaaacaacggaccuucgacaacggagccaucccacaccagcuccaccucgaggagcuggaggcaauacuacaccagcaagcaaaauacuaccccuuccucaaggaaaacuacgacaaaauaaaauccuugguaaccuuccgaauccccuacuucgucggcccacuggccaacggacagagcgaguucgcguggcucacacgcaaagcagacggcgaaauccgcccauggaacauagaagaaaaaguagacuucggaaagucagccgucgacuucauagaaaagaugaccaacaaagacacguaccugccaaaggaaaacguccuaccgaagcauucccuaugcuaccaaaaauaccucgucuacaacgaacuuacgaaagugagauacauaaacgaccaggggaaaacaucauacuuuuccgggcaggagaaagagcagauauuuaacgaccucuucaaacaaaaacgcaaagucaaaaagaaagaccuagaacucuuccuaaggaacaugucucacguagagucgcccaccaucgaagggcuagaggacucuuucaacucaucuuacuccacguaccacgaccucuuaaaaguaggcaucaaacaggaaauacucgacaaccccguaaauaccgaaaugcuagaaaacauagugaaaauacucaccguguucgaagacaagcgaaugaucaaggagcaacuccaacaguucucggacguacucgacgggguagugcucaagaaacuagaacgcagacacuacaccggcuggggcaggcuuucagcaaaacuccuaaugggaauccgcgauaaacaaucacaucugaccauacucgacuaccugaugaacgacgauggacucaaccguaacuugaugcaguuaauaaacgacaguaaccuuagcuucaaaucaaucaucgagaaagaacaaguuacaacagcagacaaggacauucagucaaucguagccgaccuagcuggcagccccgccaucaaaaaggggauacuacaaucgcucaagaucguugacgaacuugucucagucauggguuacccgccacaaacuauagucguugaaauggcaagggagaaccagacgacaggaaaaggaaagaacaauaguaggccacgauacaaaagccuggaaaaggccauaaaggaguucggcucacaaauccuaaaggaacaccccacugacaaccaggaacuacgaaacaaccgccuauaccuguacuaucugcaaaacggaaaagacauguacacgggccaagaccucgacauacacaaucucaguaauuacgauauagaccauaucguaccacagagcuucaucaccgacaacuccaucgacaacuuaguacucacgagcuccgcagggaacagagaaaaaggcgacgacguaccaccccuagagaucguacguaaacggaaggucuucugggagaaacuuuaccaaggcaaucuuaugagcaagcgcaaguucgacuaucucaccaaagccgagagagguggucuaacggaagccgacaaagcgcgauucauucaccgacagcucgucgagacacgacaaauaaccaaaaaugucgcgaacauccugcaccagagauucaacuacgagaaggacgaccacggaaacaccaugaaacaagugcgaaucgugacacugaaauccgcgcucguaucacaguuucgcaagcaauuccaacuuuacaagguccgcgacguaaacgacuaccaucacgcacacgacgccuaccucaauggcguagucgccaacacacugcucaaaguauacccccaacuagaacccgaauuugucuacggagacuaccaucaauucgacugguucaaggcgaacaaagcgaccgccaagaaacaauucuacacaaacauaaugcuguuuuucgcacaaaaggaccgcauaaucgaugaaaacggcgaaauccucugggacaagaaguaccucgacaccguaaagaaaguaaugagcuaccgccagaugaacaucgugaagaaaacagagauacagaaaggcgaguuuucgaaagcgacaaucaagcccaaaggcaacucaucgaaacucauacccaggaaaacaaacugggaucccaugaaauacggaggccuagacuccccaaacauggccuaugcaguagucauagaauacgcaaaaggcaagaacaaauuggucuucgagaagaaaauaauaagaguaacgaucauggaaagaaaagcauucgaaaaagaugaaaaggcauuccucgaggaacaagguuaccgccagcccaagguccuugccaaacuuccuaaguacacccuauacgaaugugaggaaggccggcgccgcaugcuggcaagcgccaacgaagcgcagaagggcaaccaacaagucuugccaaaccaccuaguaacccuacuacaccaugcagcaaacugcgagguguccgaugggaaaucccucgacuauaucgaaucgaacagggaaauguuugccgaacuccucgcgcaugucagcgaguucgcaaaacgauacacacuggccgaagcgaauuuaaauaaaauaaaccaacuauucgaacaaaacaaagaaggcgacauuaaagccauagcacaauccuucguggaccucauggccuucaacgcgaugggagccccagccucguuuaaguucuuugaaaccaccauugaacgcaaacgcuacaauaaccucaaagaacuacucaacucgacaauuaucuaccaaucaaucaccggccucuacgaauccaggaagagacucgacgacaaacgcccagccgcaaccaagaaggccggucaggccaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10354 - RNA, 4527 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaaacgcaaaguaggaauacacggagucccggccgccaagaaaccauacagcauaggacuagacaucggaaccaacucggucgggugggcgguagucacagacgacuacaaagugccggcaaagaaaaugaaaguacuuggcaacaccgacaaaucccacauagagaaaaaccugcugggggcacuacucuucgacuccgggaacacagccgaggaccgacgcuugaaacggacagcccgccguagauacacccggaggcguaaccgcauccucuaccuucaagaaauauucuccgaagagaugggaaaaguggacgacagcuucuuccaccgccuagaggacuccuucuuagucacggaagacaaacgcggcgagcgacaccccaucuucgggaaccucgaagaggaggucaaguaccaugagaacuucccgacuaucuaccaucuccgacaauaccucgccgauaaccccgaaaaaguagaucuccgccuaguguaucuagcgcuagcccauauaaucaaauuccggggacacuuccuaaucgaaggaaaguucgacacccgcaacaacgacguacaacgccuauuccaggaauuucuugcgguauacgacaacacauucgaaaacucaucucugcaagaacaaaauguccaagucgaagaaauccugaccgacaaaaucuccaaaagcgcuaagaaagaccgagugcucaagcuauucccgaacgaaaagucaaacggaagauucgccgaguuccugaaacucaucguuggaaaccaggccgauuucaagaaacauuucgaacuagaagaaaaagccccacuacaguucuccaaggacaccuaugaggaggaacuagaagugcuccuugcccagaucggggauaacuacgcugaacuauuccuaagcgccaagaaacuuuacgacagcauccugcucagcggcauacugacggucacggacgucggcaccaaagccccacuauccgccagcaugauacaacgauacaacgaacaccagauggaccuagcucaauugaagcaauucauccggcagaaguugucagacaaguacaacgaagucuucagcgauguuuccaaagacggcuacgccggauacaucgacggcaagacaaaccaagaagcguucuacaaauaccugaagggauugcucaacaaaaucgaagggucgggauacuuccuagacaagauagaacgugaggacuuccuaaggaagcaacguacauucgacaacggcagcaucccccaucaaauccaccuacaggaaaugcgcgcuaucauucgcagacaagcagaguucuaccccuuccuagcugacaaccaagaccgcauagaaaagcugcucaccuuuagaauccccuacuacguaggaccccucgcccgcggaaaaucggacuucgccugguuaucccgcaagagugccgauaaaauaacaccauggaacuucgacgagaucguagacaaagagagcagcgcagaggccuucaucaaccgcaugacaaacuacgaucuauaccuacccaaccaaaagguucugcccaagcacagccuacuuuacgaaaaguucaccguauauaacgaacugacgaaagucaaguacaaaacagaacaaggcaaaacagccuucuucgacgcaaauaugaagcaagagauauuugacggcgucuucaaagucuaucgcaaagucaccaaggacaaacucauggacuuccuggaaaaagaguucgaugaguuccgcauugucgaccucaccggccucgacaaagaaaacaaaguauucaacgccagcuacgggaccuaccacgaccucugcaagauccuggacaaagauuuccuggacaacagcaaaaacgagaaaauccuugaagacaucguacucacccucacccucuucgaagaccgcgaaaugauccgcaaacgacucgaaaacuacucagacuuacuaaccaaagaacaagucaaaaaguuagaaagacgccacuauaccggcuggggacgacuuagcgccgaacucauucacggcauucgaaacaaggaaucgcgaaaaaccauacuggacuaccuaaucgacgacggaaacagcaaccgcaacuucaugcagcucauaaaugacgaugcacucaguuucaaagaggaaaucgccaaagcacaaguuaucggggaaacugacaaccucaaucaagucgucucagacauagccggaaguccagcgauaaagaaagggauccuccaaagccuuaaaaucgucgacgaguuaguaaaaauaaugggccaccaaccagaaaauauaguagucgagauggcacgcgaaaaccaguucaccaaccaagggcgaagaaacagccaacaacgacugaagggccuaaccgacuccauaaaagaguucggcagccagauacuuaaagaacacccaguagaaaauagccagcuucagaacgacagauuguuccucuacuaccuacaaaaugggcgcgacauguacaccggagaggaacucgauauugacuaucuuucacaguaugacaucgaccacaucauaccacaggccuuuaucaaagauaacucuaucgacaaccggguccuaaccucauccaaggagaaucgaggaaaaucagacgaugugccuucgaaagacguaguccgcaaaaugaaguccuacuggucuaagcuccuauccgccaaacuuauaacgcaacgaaaguuugacaaucucaccaaagcggagcgugggggccucaccgacgacgacaaggccggauucauuaaacgacagcuagucgaaaccagacaaaucaccaaacacguagcccgaauacucgacgaacgcuucaacacagaaacagaugaaaauaacaagaaaauccgacaagugaaaauagucacccuuaaaagcaaccuaguauccaacuuccgaaaagaguucgaacucuacaaaguacgcgagaucaacgauuaccaccacgcacacgaugccuaccucaacgccgugaucgggaaagcgcuccuaggcguauacccccagcuagaacccgaguucguguacggcgacuacccacacuuccacggacacaaggaaaacaaggcaaccgcgaagaaauucuuuuacagcaacaucaugaacuucuucaagaaagacgacguacgaacagauaaaaacggcgaaauaaucuggaagaaagacgagcacauuuccaauauuaagaaaguacugucguauccgcaagugaacauagugaagaaaguugaagaacaaacgggaggcuuuuccaaagagucgauacugccgaaaggaaacucagacaaacuuauaccaaggaaaacgaagaaauuuuacugggacaccaagaaauacggcggcuucgauucacccaucguagccuacagcauccuaguuaucgccgacauagagaaaggcaaaagcaagaaacuaaaaacggucaaagcucugguaggaguaacuaucauggagaaaaugaccuucgaacgcgacccggucgccuuucuggagcgcaaagguuaccgcaacguccaagaggaaaauauaaucaaacugcccaaauauagucuauuuaaacuggagaacggccgcaaaagacuacucgcaucagcgcgggaacuccaaaaaggcaacgagauaguacucccaaaccaccucgguacacuccuauaccacgcaaagaacauacauaaaguagacgaaccaaagcacuuggacuauguagauaaacacaaggaugaguucaaagagcuucuagacgucguaagcaacuucucuaagaaauacacccuggcagagggcaaccucgagaaaauaaaggagcuguacgcccaaaacaacggcgaggaccucaaggagcuugccagcucauucaucaaucuccucacauucacugcaauaggcgcaccagccacuuucaaguucuuugauaagaacauagaccgaaagcgcuacacaucaaccacagagauccucaacgcaacgcucauacaccaaucaaucacaggccuauacgagacccgcaucgaccucaacaagcucggaggagauaagcgucccgccgcaaccaagaaagcaggacaagcgaaaaagaaaaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10355 - RNA, 3660 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaaaaagaaacgaaaagucggaauccacgguguacccgccgcccaaacaaccaaccucagcuacauacucggccuggaccuaggcaucgcauccguaggcugggccgucguagaaaucaacgaaaacgaggauccaaucggacucaucgacgucggaguacgcaucuucgaaagggcugaagucccaaaaacaggagagucgcuagcccucagcagacgccuggcacgaucaacacggagacuuauucgacgccgagcccaccgacuccuccuagcgaaacgauuccuaaaacgcgaagggauccuuagcaccaucgaccucgaaaaaggacucccaaaccaggcaugggagcuccgaguagcaggacuggagcgaagacuaucugcgaucgaauggggugcgguacucuuacaccucauaaaacaccgcggauaccuaagcaagcgaaagaacgaaucccagacaaacaauaaagaacugggcgcacugcucagcggagucgcacaaaaccaccagcuccugcaguccgacgacuaccgaacccccgccgaacuagcccucaaaaaguuugcuaaagaggaaggacacauucgaaaccaaagaggagccuacacgcacaccuucaacagacuagaucuacuagccgagcugaaccuauuguucgcacagcaacaccaauuuggcaacccucauugcaaagagcacauacagcaguacaugacagaacuccucauguggcaaaaaccagcccucagcggcgaggcaauccucaaaaugcugggaaagugcacacacgagaaaaacgaguucaaagccgcaaagcacaccuacucagcagaaagauucgucuggcucaccaaacuaaacaaccuccguauauuagaagacggugcagaacgcgcgcugaacgaagaagaacgacaacuccuaauaaaccaccccuacgagaaaaguaaacuaaccuacgcccaaguacgcaaacuguuagggcucagugagcaagccauauucaaacaccuccgguacucaaaggaaaacgcggaaagcgccaccuucauggaacugaaagccuggcacgccauacgcaaagcccuggaaaaccagggacuaaaagauacauggcaagaucuagcaaagaaaccagacuuacucgacgaaauuggcacugcauucucucuguacaaaacggacgaagacauccagcaauaccuaaccaacaaagucccaaacuccguaauaaacgcucuccuagucucccucaacuucgacaaauucaucgaacucagccuaaaaucacuacgcaaaauccugccccugauggaacagggcaaacgguacgaccaagccugccgagaaauauacgggcaccacuacggagaggccaaccagaaaaccucacaacuccuaccagccauacccgcccaagaaauacgcaacccgguaguccuacguacccucucacaagcccgcaaaguaauaaacgcaauaauccgacaauacggaucaccagcgcgcgugcauauagaaacaggccgagagcugggaaaguccuucaaagaacgacgcgaaauccaaaaacaacaagaagacaacaggacaaagcgggaaagcgccguccaaaaauucaaggaacucuucuccgacuucaguuccgaaccaaaaagcaaagacauccuaaaauuccggcuuuacgaacagcagcacggcaaaugccuauacucagggaaagagauaaacauacaccgucucaaugagaaaggcuacguagaaauagaccacgcccuccccuucagccgcacaugggacgacucauucaacaacaaggugcuaguguuagcaucagaaaaccaaaauaaaggcaaccagacacccuacgaauggcuccagggcaagauaaacuccgagcgauggaaaaacuucguggcccuaguacucgguucacagugcucugcggccaagaaacagcgacuccucacacaagucauagacgauaacaaauucaucgaccgcaaccugaacgacacaagauacauagcccgcuuccuguccaacuacauccaagaaaaccuucuccuaguagggaaaaacaaaaagaacguauucacuccaaacggccaaaucacagcccuacuacgaagccgcugggggcuuaucaaggcacgugaaaacaacaaccgccaccacgccuuagacgccaucguggucgccugcgcaacaccuagcaugcaacagaaaaucacucgauuuaucagauucaaggaaguucaccccuacaagauagaaaaccgguacgagaugguagaccaagaauccggagaaaucauaagcccucacuuccccgaacccugggcuuacuuccgccaagaaguaaacauacgaguguucgacaaccaccccgauacaguccucaaagaaaugcucccagaucggccacaggccaaccaccaauuuguacaaccccucuucgucucccgagccccgaccagaaaaauguccggccaggggcacauggaaaccaucaaaucagcgaaacgacuggccgagggcaucagugugcugcguauaccccuaacccagcucaaaccaaaccuccucgaaaacaugguaaacaaggagcgagagccagcccuguacgcaggacuaaaagccagacucgcagaguucaaccaagauccagcgaaggccuucgcaacacccuucuacaaacagggaggccaacaggugaaagcgauaagagucgaacaaguccaaaaauccggaguccucguccgagaaaacaacggggucgcggacaacgccagcaucguaagaaccgacguauucaucaaaaacaauaaauucuuccucgucccaaucuacaccuggcaggucgccaaagggauccuuccaaacaaagcuaucguggcccacaaaaacgaagaugagugggaagagauggacgaaggagcgaaauucaaguucucacuuuuccccaacgaccucguggaacucaaaaccaagaaagaguacuucuucggauacuacaucggucucgaccgagccaccgggaacaucucucugaaagaacacgacggcgaaauuuccaaaggaaaagacggcguauaccgggucggggucaaacucgcacugucguucgagaaauaccaggucgacgaguuggggaagaaccgucaaauaugccgaccacaacaaagacaacccguacgaaaacgacccgcggccacaaagaaagcuggacaagccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10356 - RNA, 3738 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccgaaaaagaaacgaaaagugggcauucacggaguaccggcagcggccgcauucaaacccaacccaauuaacuacauccucggacucgacaucggcauagcaagcgucggaugggccauggucgaaaucgacgaggacgaaaaccccauaugccuaauagaccuugguguccgcguauucgagcgagccgaaguacccaaaaccggggacagccucgcgauggcgcgcaggcucgcccgaucuguuaggagacucacccgacgccgugcccaccgccuacuccgugcacgccgacuacucaaaagagaaggcgugcuccaagccgcagacuucgacgaaaacgggcucaucaaaucgcuccccaacacucccuggcaguuaagagccgcugcacuggaucgaaaacucacgccacuagaaugguccgccguacuccuccaccuaaucaagcaccggggcuaccugagccaacguaagaacgagggcgagaccgcggacaaagaacuaggagcgcugcuaaaaggagucgccgacaacgcgcacgcccuccaaacgggagauuuccgcacccccgccgagcucgcccuaaacaaauucgagaaagaaagcggacacauacgaaaccaaagaggcgacuacagucacacauucagccgaaaagaccuccaagccgagcuaauccuacucuucgagaaacaaaaagaguucgggaacccccacgucuccggagggcuaaaagaaggaauagaaacacucuuaaugacacaaagaccagcgcuaucaggagacgccguccagaaaaugcucggccauugcaccuuugaaccugccgaaccaaaggccgccaaaaacacauacaccgcagagagauucauauggcuaaccaaacuuaacaaucuccgcauucuagaacaaggcucagaacgaccacuaaccgacaccgaacgagcgacccugauggacgaaccauaccgcaagucaaaacugacguaugcacaagcccgcaaacuccucggccucgaagacacagccuucuucaaaggccuaagguacggaaaagacaacgccgaagccucgacacucauggagaugaaggcguaccacgcaauaucccgagcccucgaaaaagaaggccucaaggacaagaaaagcccccucaaccuuucgccagagcuacaagacgaaauaggcacggcguucagccucuucaaaaccgacgaagacauaaccggccgccuaaaagaccgcauacaaccagaaauccucgaagcacuccugaaacacaucucauucgacaaauucguacagaucagucugaaagcacugcgacgcaucguaccccugauggagcaagguaaaagguacgacgaagcaugcgccgagaucuacggagaucacuacggcaagaaaaacacugaagagaaaaucuaccuacccccuauccccgccgacgaaauaagaaaccccguggugcuacgcgcccucagccaagcacgaaaagugauaaacggcgucguacggcgcuacggaucacccgcccgaauacacauagaaacagcccgagaggucggcaaaucauucaaagaccgcaaggaaaucgagaagcgacaagaagaaaaccgaaaagaccgcgagaaagcggccgcaaaauuccgggaauacuuccccaacuucgucggagaaccaaaaucaaaagacauacuaaaacucaggcuauacgaacagcagcacggaaaaugucuauacucgggaaaagaaaucaaccucggacgacuaaaugaaaaaggcuacguagagauagaucacgcgcuaccguuuagccgcaccugggacgacagcuucaauaacaaaguacucguacuaggauccgaaaaccagaacaaaggcaaccaaaccccguacgaguacuucaacggcaaagacaacucacgagaauggcaagaguucaaagcaagaguagaaacgagcagauuuccacgaucaaagaaacaacgaauccuacuucaaaaauucgacgaagacggauucaaagaaagaaaccuaaacgacaccagguauguaaacagauuccucugucaauucguagccgacagaaugcgucucacugggaaaggaaagaaacgagucuucgcaagcaacggacagaucacaaauuugcuccgaggauucuggggccuccgaaaagucagagcagaaaacgaccgccaccacgcucuagaugccguaguggucgcuugcagcacgguagcgaugcaacagaaaaucacacgauucguccgauacaaagaaaugaacgcauucgaugguaaaacuaucgauaaagaaacaggagagguacuucaccaaaagacccacuucccccaacccugggaguucuucgcccaagaagucaugauccgagucuucggaaaacccgacgggaaacccgaguucgaagaagcagacaccccagaaaaacuacgaacccuacucgcagaaaaacuuagcucuagacccgaagccguccacgaauacgucacuccacuauucgugucacgcgcucccaacagaaaaaugagcggccaaggacacauggagacaguaaaguccgccaagcgacucgaugaaggagucuccguccugcgaguaccucucacccaacuaaaauugaaagaccucgaaaagaugguaaaccgcgaacgagaaccaaaguuauacgaagcgcugaaagcccgacucgaagcccacaaagacgacccagccaaagcauucgccgaacccuucuacaaauacgacaaagccggcaaccggacacaacaaguaaaagccguccggguggagcaaguacagaaaacaggcgucuggguacgaaaccacaacggaauagcggacaacgccaccaugguccgcguagacguauuugagaaaggcgacaaauacuaucuugucccgauauacucguggcaagucgcaaagggcauccucccggaucgggcgguaguacagggcaaagacgaagaagacuggcaacucauagacgacuccuucaacuuuaaguuuagucuacacccuaacgaucucguugaaguaaucaccaagaaagcacgcauguucggcuacuucgcgagcugucauagaggcacgggcaacaucaacauccgaauccacgaccuagaccacaaaauuggcaaaaacggaauccuagagggcaucggagucaaaacagcucuguccuuccaaaaauaucaaaucgacgaacucggcaaagaaauacgcccgugucgacucaagaaacgacccccaguccgaaaacgaccagcagcaaccaagaaagcaggacaagcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10357 - RNA, 3744 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcacccaaaaagaaaagaaaaguaggcauacauggcguccccgcagcaaaauaucaugugggaauagaugucgggacauucuccgugggccucgcagcaaucgaagucgacgaugccggaaugcccauaaaaacucucucacuugucucgcacauccacgacagcggccucgaccccgacgaaauaaaauccgcgguaacacgacucgcauccagcggcaucgcacgcaggacaagaagacucuacaggagaaaacgccggagauuacagcaacuggacaaauucauacagagacaaggauggccagugaucgaacuagaagauuacucagacccccuauaucccuggaaaguccgcgcagaacucgccgccuccuacaucgcagacgaaaaagaacggggcgaaaaacuaagcguagcacuccgccauauagcacgccaccggggauggcgcaaccccuacgccaagguaucaagccuguaucucccggacggcccguccgacgcauucaaagccauacgagaagagauuaaacgagccagcggacaaccaguaccagagacagccacagucggccagauggucacgcuuugcgaauuaggaaccuuaaaacuuaggggcgaaggaggaguacucucagcccgacuucaacaguccgacuacgcucgugaaauacaagagaucugccgcaugcaagaaauagggcaggaauuauacagaaaaauaaucgacguaguauucgcagcagagagccccaagggauccgcaagcagcagaguaggaaaggacccacuccaacccgggaaaaacagagcgcuaaaagccagcgacgcauuccagagauaccgaauagcggcacugauaggaaaccuuaggguacguguagacggagaaaagcgaauacuaagcgucgaagagaaaaaccuuguauucgaccaccugguaaauuuaaccccaaagaaagaaccagaauggguaacaauagccgaaauacuuggcaucgacagaggacaacuuauaggcaccgcgacuaugacagacgacggagaacgagcaggagcucggcccccaacacacgacacgaaccgcucgaucguaaauucacgcaucgcaccccuaguagacugguggaaaacggcaagcgcacuagagcaacacgccauggucaaagcacuaucaaaugcagaagucgacgacuucgacagcccggagggagcaaaaguucaagccuucuucgcagaccuagacgaugacguacacgcgaaacucgauagucuccaccucccaguuggucgcgccgcauacagugaagacacacucguccgacuaacacgcagaaugcuuuccgacggcguagaccuuuacacggcacgauuacaagaguucggaaucgaaccaaguuggacaccacccacacccaggauaggggaaccggucggaaauccagccguggacagaguucuaaaaacaguaucgagauggcuagaaagugcgaccaaaacauggggcgccccagaacggguaauuauagaacauguuagagagggauucgucaccgagaaaagagcaagggaaauggacggugauaugaggcgacgcgcagcaaggaacgcaaagcuauuucaagaaaugcaggaaaagcucaacguacaaggaaagccaagccgcgccgaccucuggcgcuaccaauccguacagcgccaaaacugucaaugugcguacuguggaagccccaucaccuucagcaacucagaaauggaccacauuguaccgagagccggacaaggcucaaccaacaccagagaaaaccuagucgccguaugccaccgguguaaccaaagcaaggggaacaccccuuucgcaauaugggcgaaaaacacaagcaucgaaggaguauccguaaaggaagcaguggaaagaacacgccauugggucacagacaccgggaugagaagcacagacuucaaaaaguuuaccaaggcaguagucgaacgcuuccaaagagccacaauggacgaagagaucgacgccagauccauggaaucaguggcauggauggccaacgaauuaaggagccggguggcucaacacuuugcaucacauggaacuaccguacggguauacagaggaagccuaaccgcagaagcccgccgagccuccggcaucuccggaaagcucaaauucuucgacggcguaggaaaaucccggcuggaucggcgccaccacgccaucgaugcggccguaauagccuucacauccgacuauguggcagaaacccuagcaguccguagcaaccucaaacagucgcaagcacaccggcaagaggcaccccaauggagggaguucaccggcaaagacgccgaacaccgggccgccuggcgcgucuggugccagaaaauggaaaagcuaagcgcccuacuaacggaggaccuccgggaugacagaguaguagugaugaguaacguccgacucagacuaggaaacggcucagcacacaaggaaacuauaggcaaacuaucaaaagucaaacucucaucgcaacuaagcguuucagacaucgacaaagccuccagcgaagcacuauggugcgcacucaccagagaacccggcuuugacccgaaggaagguuugccggcaaacccagaaaggcacauucgaguaaacggcacccacgucuacgccggcgauaacaucggacucuucccuguuuccgcggggucuaucgcucuaaggggcggcuacgcagaacucggaagcuccuuccaccacgcgcgaguauacaaaaucacauccggcaagaaaccagcauucgccaugcugcgcgucuacacaauagaccuuuugcccuaccggaaccaagaccucuuuagcguggaacuaaaaccgcaaacuaugucaaugcgccaagcagaaaagaaacuccgggaugcucuagcaaccggaaacgcggaauaucucggcuggcuggugguggacgacgagcuaguagucgacacgucgaaaauagcaacagaccaagugaaagcaguagaagcagaacuagggacaauacggcgauggcgagucgauggguucuucagccccucaaaacucagacuaagaccacuccaaaugagcaaagaagggauaaagaaagaauccgccccagaacugucaaaaauaauagauagaccaggcuggcuuccagcagucaacaaacucuucucagauggcaacgucacagucguaagacgggacucauuaggucgaguccggcucgaaucgacagcccaucugcccguuacauggaagguacagaagcgccccgcagccacaaagaaagccggucaagcuaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10358 - RNA, 3444 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcgccgaaaaagaaacgcaaagucggaauacacggaguacccgcggccgcccguauccucgccuucgacaucgguauauccucgaucggcugggcauucuccgaaaacgacgaacucaaagacugcggcguacgcauauucacaaaaguagaaaauccgaagaccggggaaucccucgcacucccacgcagacuggcgcgaagcgcccgcaaacgccucgcacgccggaaagcgagacucaaucaucucaaacaucucaucgccaacgaguucaagcuaaacuacgaagacuaccagucguucgacgaaucccucgcgaaagccuacaaaggcagccuaaucuccccuuaugaacugcgcuuccgagcccuaaacgaacugcugagcaaacaagacuucgcccggguuauccuucauaucgcgaaacgacggggcuacgacgacaucaaaaacucagacgacaaggaaaagggagcgauacucaaggcgauaaagcaaaacgaagaaaaacucgccaacuaccagucagucggagaguaccucuauaaagaauauuuucaaaaguuuaaagagaacuccaaggaguucacgaaugucagaaacaaaaaggaaagcuacgaacggugcauagcccaguccuuucugaaagacgaguuaaagcucaucuucaagaaacagcgggaguucggguucucguucuccaagaaauucgaggaagaaguccucucagucgcuuucuacaaaagagcacuaaaagacuucagccaccucguaggaaacugcuccuucuucaccgacgaaaaacgcgcccccaaaaacagcccacucgcguucauguucgucgccuuaacacgcaucaucaaccuccuaaacaaccucaaaaacacggaaggcauccuauacacgaaagacgaccucaacgcgcuacugaaugagguccuaaagaacggaaccuuaaccuacaaacaaacgaaaaagcuacucggucuuucggaugacuacgaguucaaaggggaaaaaggcaccuacuucaucgaguucaagaaguacaaggaauuuauuaaagcacuaggcgaacacaaucugucacaagaugaccucaacgaaaucgcaaaagacaucacccugaucaaagacgaaaucaagcuaaagaaagcgcuugccaaauacgaccucaaccaaaaccaaaucgacagccuuuccaaacuagaauuuaaagaccaccuuaacaucagcuuuaaagcacuaaagcuaguaacaccccuaaugcucgaagguaaaaaguacgaugaggccuguaacgaacugaaccugaaagucgccauuaacgaagacaaaaaggacuuccuacccgccuucaacgagacauauuacaaagaugaagugaccaaucccgugguacuacgcgccaucaaagaguacagaaagguacugaacgcuuuacucaagaaauacggcaaaguacacaaaaucaacaucgaacucgcacgugaagucggcaaaaaccacucccagcgcgccaaaauagagaaagaacaaaacgaaaacuacaaagccaagaaagacgccgaacuagaaugcgaaaaacucggacucaaaaucaacuccaaaaacauccuaaaacuccgccucuucaaagaacaaaaagaguucugcgccuacagcggagagaagaucaaaaucagcgaccugcaggacgagaagaugcuggaaaucgaccacaucuaccccuacagccgcagcuucgaugauuccuacaugaacaagguacucguauucacaaaacagaaccaagaaaagcucaaccaaacaccauucgaggccuucggcaacgacagcgcaaaauggcaaaagaucgagguccuagcaaagaaccuaccaaccaagaaacaaaaacgcauacuagacaaaaacuacaaggacaaggaacagaaaaacuucaaggaucgcaaccugaacgacacgcgauacauagcacggcucgugcucaacuacaccaaagacuaccucgacuuccuaccccuaagcgacgaugaaaacacaaagcucaacgacacccagaaaggcucaaaaguucauguagaagcgaaaagcggaaugcuaaccuccgcccucaggcacacguggggauucagcgcgaaagacagaaacaaccaccuacaccacgccaucgacgcggucaucaucgcguacgcaaacaauucuauugucaaggcauucucggacuucaagaaagaacaagaauccaacucggccgaacucuacgcgaaaaagaucucggagcuagacuacaaaaacaaacgaaaauucuucgaacccuucagcgguuucaggcaaaaaguccuggacaaaauagacgagauauucgucuccaagccagagcgaaagaaacccagcggagcacugcacgaagaaaccuucaggaaagaagaagaauuuuaccaauccuacggcgguaaagaaggggugcucaaggcacucgagcuaggcaaaauacgcaaaguaaacggcaagaucgucaagaacggagacauguuccggguugacauauucaaacacaagaaaaccaacaaauucuaugcagucccaaucuauacaauggacuucgcacucaaaguccugccaaacaaagcugucgcgcgcagcaagaaaggcgaaauuaaagacuggauacuuauggacgagaacuacgaguucugcuuuucccucuauaaagacucacuaauacucauccagaccaaagacaugcaagaaccggaguucgucuacuacaacgccuucacgagcagcaccgucagccuaaucguaucaaaacacgacaacaaauucgaaacucugucgaaaaaccagaaaauccucuucaaaaacgccaacgaaaaagaggugaucgcgaagucuauuggcauucaaaaucucaagguguucgagaaauacaucgucagugcccugggagaagucaccaaggcagaguucagacagcgggaagacuucaagaagaaacgcccggccgcaacaaagaaagccgggcaagcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10359 - RNA, 3855 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaaaaagaagcgaaaaguuggaauacauggcgucccagccgccuccgaccucgugcugggccuagacaucgggaucggaagcguaggagucggcauccuaaauaaaguaacaggagaaaucauccacaaaaacucacgaaucuucccagcagcccaagcagaaaacaaccuagucagacgcacaaaccgccaagggcgucgauuagcccgacgcaagaaacaccgcaggguccgccuaaaccgccucuuugaggaaaguggccuaaucacggacuuuaccaagauuucaaucaaccuuaacccguaccaacuacgagucaaagggcucacagacgaacuaagcaacgaagaauuauucauagcacucaagaacaugguaaagcaucgcggcaucucguacuuggaugacgccagcgacgacgguaacuccucggucggagacuaugcccaaaucgugaaagaaaacuccaaacaacuugagacaaaaacaccaggccaaauccaacuagaacgcuaccaaaccuacggccagcucagaggagauuucaccgucgagaaagacggcaagaaacaccgccucauaaacgucuuccccaccuccgcguaccggagcgaagcccugcguauccuccaaacacaacaggaauuuaacccacaaaucaccgacgaguucauaaacagauaccuagaaauccuuacggggaaacgcaaauacuaccacggccccggcaacgagaaaagccgcaccgacuacggacgcuacaggacaucaggcgaaacccuggacaacauauuuggaauacucauagggaagugcaccuucuacccagacgaguuccgagccgccaaagcuagcuacaccgcccaagaguucaaccuccucaacgaccuaaacaaccucaccgugcccacagaaaccaagaaacucagcaaagaacagaaaaaccaaaucaucaacuacgucaaaaacgaaaaagcuaugggucccgcaaaacucuucaaauacauagcaaaacuccuaagcugcgacguagccgacauaaaaggauacaggauagacaaaagcggcaaggccgaaauccacaccuucgaagccuaccggaaaaugaaaacccuggaaacccucgacaucgaacaaauggaccgcgaaacacuggacaaauuagccuacguacugacccuuaacacugaacgagagggaauccaagaagcccucgagcacgaguucgccgacggcaguuucucgcaaaaacaaguagacgaacucgugcaauucagaaaagcaaauuccagcaucuucggaaaaggguggcacaacuucagcgugaaacugaugauggaacucauccccgaacucuacgaaaccucagaggagcaaaugacaauccugacacgccugggcaaacagaaaaccacgagcagcagcaacaaaacaaaguauaucgacgagaaacugcuaaccgaagaaauauacaaccccgucgucgccaagagcguaagacaagcgaucaaaaucgucaaugcggcgaucaaagaauacggcgacuucgacaacaucguaaucgaaauggcccgggaaacgaacgaagacgacgagaaaaaggccauccagaaaauccaaaaagcaaacaaggacgagaaagacgccgcgaugcuuaaagcggcgaaccaauacaacggcaaggccgaacucccacacagcguauuccacggacacaaacaacuagccacaaaaauccgacuauggcaccaacaaggcgaacgcugccuauauaccggcaaaacaaucucaauccacgaccucaucaacaacagcaaucaauucgagguggaccauauccuaccccuaucaauaacauucgacgacagccuggcaaauaaaguacucguauacgccaccgcaaaccaggaaaaaggccaacgcaccccguaccaagccuuggacuccauggacgacgccuggagcuuuagggagcugaaggccuuugucagggagagcaagacacuuagcaacaaaaagaaagaguaccuccuaacagaggaggacaucucaaaguucgacguaagaaagaaauuuauagaacgcaaccugguugacacgcgcuacgccucaagagucguacucaacgcccuccaagaacacuucagagcccauaaaaucgacaccaaaguauccgucguccgcggccaguucacaagccagcucagaaggcacuggggcaucgagaaaaccagagauaccuaccaccaccacgccguagacgcacugaucauugccgccuccucgcaacucaaccuauggaagaaacagaaaaacacccuagucagcuauucggaagaccaacuacucgacaucgagacgggcgaacuuauaucagaugacgaauacaaagagucuguauucaaggcuccguaucaacacuucguggacacccucaaaagcaaagaguucgaagacucgauccuguucuccuaccaaguggacuccaaauucaaccgaaaaaucuccgacgccacgaucuacgcaacacgccaggcgaaaguaggcaaagacaaagcggacgagaccuacguacucggaaaaauaaaggacaucuauacccaagacggguaugacgccuucaugaaaaucuacaagaaagacaaaagcaaauuccucauguaccgucacgacccccagacauucgagaaagucaucgagcccauccuagaaaacuaccccaacaagcaaaucaacgaaaaaggcaaagaaguaccaugcaacccuuuccuaaaauauaaagaggaacauggcuacauucgaaaauacagcaagaaaggaaacggaccagaaauaaaaucacuaaaguacuacgacaguaaacuaggcaaccacaucgacaucaccccgaaagacagcaauaacaaggucguacuacaaagugucagucccuggcgagcggauguuuauuucaacaagaccacagggaaguacgaaauucucggacuuaaauacgcagaccuccaauucgaaaaagggaccggaaccuacaagauaagccaagaaaaauacaacgacaucaagaagaaggaggggguagacucagacucggaguucaaauuuacacuguauaaaaaugaccugcugcuaguaaaagacacagaaaccaaagaacagcaacuauuccgcuuccuaagcagaacuaugcccaagcaaaaacacuacguggaacuaaaacccuacgacaaacaaaaguuugaaggcggagaagcccucaucaaaguccucggaaacgucgcgaacuccggccaaugcaagaaaggacuaggaaaaagcaacauuucuaucuacaaaguucgaacagacguacuaggaaaccaacacauaaucaaaaacgaaggagacaaaccgaaauuagacuucaagcgccccgcagccaccaaaaaggccggccaagccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10360 - RNA, 4413 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcacccaaaaagaaacgaaaagucgggauucacggaguccccgcagcaacgcaauucgaaggauuuacgaaccucuaccaaguaucgaaaacacuccgcuucgaguuaaucccccagggaaaaacacuaaaacacauacaggaacaaggauucauagaagaggacaaagcacgcaacgaucacuacaaagaacuaaaaccgaucauagaucgaauuuacaaaacguacgccgaucaaugccuacaacucgugcaacucgacugggaaaaucuuuccgccgcaauugacucauauagaaaagagaaaacggaagaaacccgaaacgcucuaauagaggaacaagcuacguaccguaaugccauacaugacuacuucauaggccgcacagacaaccucaccgacgccaucaacaagcgccacgcagagaucuauaaaggacucuuuaaggcggaacuauucaauggaaaaguccucaaacaacuggggacaguuacuacgaccgaacacgagaacgcucuccugcgcucauucgacaaauucacaacuuacuucucaggguucuacgaaaaccgcaaaaacguauucucagcagaagacaucuccaccgccaucccgcaccgcauagugcaagacaacuucccaaaguucaaagaaaacugccacaucuucacacgccuuauaaccgccgucccaucucuacgcgaacacuucgagaacgucaagaaagccaucggcaucuucgucucgaccagcaucgaggaagucuucucauucccguucuacaaccagcuccucacccaaacacaaaucgaccuguacaaucagcuccucggagggauauccagagaagccgggacagaaaagauuaaaggacucaacgaaguccucaaucuagcaauccagaaaaacgacgaaaccgcgcauaucaucgcaucccucccccauagguuuaucccccuauucaaacaaauccuguccgaccgcaacacucugucuuucauucucgaagaguucaaauccgacgaggaaguaauacaauccuucugcaaauauaagacucuucuaagaaacgaaaacguguuagaaaccgcagaagcacucuuuaacgaacuuaacuccaucgaccugacucacaucuucaucagccacaagaaacuggagacaaucagcuccgcacucugcgaccacugggauacccuccgaaacgcacucuacgaacgcagaaucuccgagcuuaccggcaaaaucaccaaaagcgcaaaagaaaaagugcaacgauccuuaaaacacgaagauauaaaccuccaagaaaucaucagcgcggccgggaaagaguugagcgaagccuucaaacagaaaaccuccgaaauccuaagccacgcccacgcagcacucgaccaaccccuucccaccacccucaagaaacaagaagaaaaagaaauacugaaaagccagcuugacucccuacuuggauuauaccacuugcuagacugguucgccgucgaugaaagcaacgaagucgaccccgaguucuccgcacggcucaccggaauuaaacucgaaauggaaccaagccuuagcuucuacaacaaagcacgcaacuacgcaaccaagaaacccuacagcguagaaaaauucaaacuaaauuuccagaugcccacacuggccucagggugggauguaaacaaagagaaaaacaacggagcgauauuauucgugaaaaacggccuuuacuaccuuggaaucaugcccaaacagaaaggccgcuacaaagcgcucuccuucgaaccgacagagaaaaccucugaaggauucgacaaaauguacuacgacuacuucccagacgccgccaaaaugaucccaaaaugcuccacgcaacucaaagccgucaccgcccauuuccagacgcauacaacacccauccuccugucaaacaacuucauugaaccgcuugaaauaaccaaagaaaucuacgaccucaacaauccagaaaaggaaccaaagaaauuccaaaccgcauacgccaagaaaacgggcgaccagaaaggcuauagagaagcucuaugcaaauggauugacuucacgcgggauuuccuguccaaauacacaaaaaccaccucaauugaccuaaguucgcuccgacccuccagucaauacaaagaccuaggggaauacuacgccgaacucaacccccuucuauaccacaucuccuuccaacgcaucgcagaaaaggaaaucauggacgccguugaaaccggcaagcuauacuuguuccagaucuacaacaaggacuucgccaagggacaccacggcaaaccaaaccuacauacccucuacuggaccggacuauucagcccugaaaaucuugcuaaaacguccauaaaacucaacggccaagcugaacuuuucuaccgucccaaaucgcgcaugaaacggauggcccaccgacucggcgagaagauguuaaacaagaaguugaaagaccaaaagacaccaauccccgacacacuguaucaggaacucuacgauuacguaaaccaucgucucucucacgaccucuccgacgaggcccgcgcgcuccucccuaaugucauuaccaaggaaguaucacacgaaaucauaaaggaccgccguuuuaccucggacaaauuuuucuuccacgugccaaucacacucaacuaccaggccgccaacagcccuucaaaauucaaccagcguguuaacgccuaccuuaaagagcaccccgagacucccauaaucggcaucgaccgcggagaaaggaaccuaauauacauuaccgucauagacuccacggguaaaauccuggaacagcggucccucaacaccauacaacaauucgacuaccagaagaaacuagacaaccgagaaaaagagcgaguagcagcccgacaagccugguccgucguggguaccaucaaggaccuuaagcagggguaccucagucaaguuauccacgaaauuguagaccucaugauccacuaccaagcgguugucguccuggagaaccugaauuucggguucaaaucaaaaagaaccggcaucgccgaaaaagcugucuaccaacaauucgagaaaaugcuaaucgacaaacuaaacugccuaguacugaaagacuacccagccgaaaaagucggcggaguccuuaacccauaccaacuaaccgaucaauucacuagcuucgcaaagaugggaacgcagucgggauuccucuuuuacguuccggcccccuauaccuccaaaaucgacccccuuaccggcuucguagacccguucgucuggaagacgauuaaaaaccacgaaucaagaaaacacuuucuagaaggcuucgacuuccugcacuacgacguaaagacaggagauuucauacugcacuucaaaaugaaccgcaauuuguccuuccaacgagggcuccccggguuuaugccagcgugggacaucgucuucgagaaaaacgaaacucaauucgacgcuaaaggcaccccauuuauagccggcaaacguaucguaccagucaucgaaaaccaccgcuucaccggccguuacagagaucucuaccccgcgaacgagcuaauagcacuacuggaggaaaaaggaauagucuucagagacggcagcaacauccuuccaaagcugcuagagaacgacgacucccacgccaucgacacgauggucgcccucauccgauccgugcuccaaaugcgaaacuccaacgcagccacgggagaggacuacauaaacagucccguccgagaccuaaacggcgucugcuucgacucucgcuuccagaacccagaauggcccauggacgcugacgccaacggcgcguaccacaucgcccucaaaggccagcuccuacuaaaccaccuuaaggagagcaaagaccucaaacugcaaaacggcaucagcaaccaggauuggcucgccuacauccaagaacuaaggaacaaacgacccgcagcuacaaagaaagcuggccaagcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10361 - RNA, 4392 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccgaagaagaagcgaaaggugggcauucauggggugccugcggcauccauauaccaagaauuuguaaacaaauacucccucucuaaaacacuccgcuucgaacuaaucccccaggguaaaacccuggaaaauaucaaagcgcgcgggcucauucuagacgacgagaaacgcgcaaaggacuacaagaaagcuaagcaaaucaucgauaaauaucaucaauuuuucauagaagagauccucuccagugucugcauaagugaggaccuccuccaaaacuacucggacguuuacuucaagcucaagaaaucagacgacgacaaccuccagaaagacuucaagagcgcgaaggauaccauuaagaaacagaucuccgaauacauaaaagacuccgaaaaauucaaaaaccucuuuaaccaaaaccugaucgacgcgaagaaaggccaggaaucagaccuaauacuauggcuaaaacaaucaaaagauaacgggaucgaacucuucaaagccaacagcgacaucaccgacaucgacgaagcgcuagagauaauaaaauccuucaagggcuggaccaccuacuucaagggauuccacgaaaaccgcaagaacguauacucaagcaaugacauccccacguccauaaucuaccgcaucguggacgacaaccucccaaaguuccucgaaaauaaagccaaauacgagagccucaaggacaaagcaccagaagcgauuaauuacgagcaaaucaagaaggaucucgccgaagaacugacauuugacaucgacuacaaaacaagcgaagugaaucaaagaguauucucucuggacgaaguauucgaaaucgcgaacuucaacaacuaccucaaccaauccggaaucacuaaauuuaacacaaucaucggcgguaaauucgucaacggggaaaacacaaaacgcaaaggcaucaaugaauacaucaaccucuacagccagcaaaucaacgacaaaacucucaaaaaguacaaaaugucgguguuauucaaacaaauacuauccgauacggaauccaaauccuucguaaucgauaaacucgaggacgauagcgacgucgucaccacaaugcaaucguucuacgaacaaaucgcugccuucaaaacaguggaagagaaauccaucaaggaaacccuuuccuuacucuuugacgaccugaaagcacagaaacuugaccucucaaagauauauuucaaaaaugacaaaagccugacugaucucucucagcagguauuugacgacuacucggucaucgguaccgccgucuuagaguacaucacacaacaaauagcacccaaaaaccucgacaacccauccaaaaaggaacaagaacuaauugccaagaaaacagaaaaagcgaaauaccuaagccuagagacgaucaaacuggcgcucgaagaguucaacaaacaccgcgacauugacaagcaaugccgcuucgaagaaauccucgcuaacuucgccgccauacccaugaucuucgaugaaauagcgcaaaauaaggacaaccucgcccaaauaagcaucaaauaccagaaccaaggcaagaaagaucucuuacaagccagcgcagaggaugacgugaaagcaauaaaagaccugcuggaccagacaaacaaccuucuccacaaacugaaaaucuuucacaucucccagucagaagacaaagcaaacauacuggacaaagacgaacacuucuaccugguuuuugaggaaugcuacuucgaacuagcaaacaucgucccccucuauaacaagauccgaaacuacaucacccagaaaccguauagcgacgagaaauucaagcucaauuuugagaacuccacgcuggcaaacgguugggacaagaacaaagagccugacaacaccgccauacucuuuaucaaggacgacaaauacuaccucgggguaaugaacaagaaaaacaauaaaaucuucgaugacaaagccaucaaagaaaacaaaggggaagguuacaagaaaaucgucuacaaacuacucccaggcgccaacaaaaugcuacccaaagucuucuuuagcgcaaagucgaucaaguucuauaacccauccgaagauauacugcgaauacgaaaucacucgacgcacacgaaaaacggcagcccgcaaaaaggcuacgagaaauucgaguuuaacauagaggacugccggaaauucaucgauuucuacaagcaguccauaucaaagcacccagaauggaaagacuucggguuucguuucagcgacacacaacgauauaacagcauugacgaauuuuaccgcgaaguagaaaaccaaggauacaaacugaccuuugagaacauaagcgagagcuacauugacagcguaguaaaccaaggcaaacucuaccucuuucaaaucuacaacaaggacuuuuccgccuacuccaaaggacgcccgaaccuccacacccuuuacuggaaagcacuauucgacgaacgcaaccuccaggacgucgucuauaaacugaauggcgaagccgaacuguucuacagaaaacaaucgauaccaaagaaaauaacacacccagccaaagaggccauagcgaacaaaaacaaagacaaccccaagaaagaaagcguauucgaguaugaccucauuaaagacaagcgcuuuacggaggacaaguucuuuuuccacugccccaucacgaucaacuuuaaguccagcggcgccaauaaguucaacgacgagauuaaucugcuacucaaggaaaaagccaacgacgugcacauccuaaguauagaccgaggagaaagacaccuggcauacuacacacucguggacgggaagggcaacaucaucaaacaagacaccuuuaacauaaucggaaaugaucggaugaaaaccaacuaucacgacaagcuagcagcgaucgagaaagaccgggacuccgcccgcaaagacuggaagaaaauaaacaacaucaaagagaugaaggagggauaccuaucgcaaguaguacacgaaaucgccaagcucgucauugaauacaacgcaauugugguauucgaggaccucaacuucggauuuaagaggggucgcuucaaaguagaaaaacaagucuaucaaaaacuugaaaagaugcucaucgaaaaacugaacuaucucguuuucaaggacaacgaguucgauaaaaccggcggcgugcuccgggccuaccaauuaaccgccccauucgaaacguucaaaaagauggggaaacaaaccggcauaauauauuacgucccagccggguucacauccaaaaucugcccggucaccggauucguaaaccaacuauaucccaaguaugaaucagucagcaagagccaagaauuuuucucuaaguuugacaaaaucugcuauaaucucgacaagggauacuucgaauuuagcuucgacuacaagaacuucggcgacaaagcggccaagggcaaguggaccauagccagcuucgguucccgccucaucaauuuucgcaacuccgacaagaaucacaauugggacacaagagaagucuaccccaccaaagaacucgagaagcugcuaaaggacuacagcauugaauacgggcacggcgaaugcauaaaagcagccaucugcggggagagcgacaagaaauucuucgccaaacucaccagcguacugaacacaauacugcaaaugcgcaacuccaaaacaggcaccgaacucgacuaccugaucagccccguggccgaugucaacggcaacuuuuucgacucgagacaagcgcccaaaaacaugccacaagacgccgacgccaacggcgcauaccacaucgggcucaaaggucugaugcuacuaggccguauaaagaacaaccaggaggggaagaaacugaaccuaguaauaaagaacgaggaauauuucgaguucguccaaaacaggaauaacaagaggcccgccgccacgaaaaaggcaggccaggccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10362 - RNA, 4596 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaagugggaauccacggggugccggcggcggacaagaaguacagcaucggccuggacaucgggaccaacucagugggcugggccguaaucaccgacgaauacaaaguccccagcaagaaguucaaggugcuggggaacacggaccggcauuccaucaagaagaaccugaucggugcccugcuguucgacucgggcgagaccgccgaggccacccgccugaagcgaaccgcgcgccggcgcuacacgcggcgcaagaaccggaucuguuaccugcaggagaucuucuccaacgagauggccaagguggacgacagcuucuuccaccgccucgaggaguccuuccuggucgaggaggacaagaagcacgagcggcaccccauuuucgggaacauuguggacgaaguggccuaccacgagaaguaccccaccaucuaccaccuucgcaagaagcucgucgacagcaccgacaaggccgaccugcggcugauuuaccucgcgcuggcccacaugaucaaguuccgcggccacuuccugaucgagggggaccucaacccggacaacuccgacguggacaagcuguucauccaacuggugcagaccuacaaccagcuguucgaggagaaccccaucaacgccagcggcgucgacgccaaagccauccuguccgcgagacuuagcaagagucgcaggcucgagaaccugaucgcccagcuucccggggagaagaagaacggccuauucggcaaccugauugcccugagccucggacugacacccaacuucaaguccaacuucgaucuggccgaggaugccaaacuccaguugaguaaggacaccuacgacgacgaccuggacaaccuccuggcgcagaucggcgaccaguacgccgaccuguuccucgccgccaagaaccugucugacgccauccugcucagcgacauccugcgcgugaacaccgaaaucaccaaggcgccgcuguccgccucaaugaucaagcgguacgacgagcaccaccaggaucucacgcugcugaaggcgcuagugcgccagcaguugcccgagaaauacaaggagaucuucuucgaccagagcaaaaacggguacgcuggcuacaucgacggcggggccucccaggaggaguucuauaaguucaucaagcccauacuggagaagauggacggcaccgaggaguuacuggucaagcugaaccgggaggaccugcuccgcaagcagcgcaccuucgacaaugggagcaucccccaccagauccaccugggcgagcugcacgcgauccuccggcgccaggaggacuucuacccguuccugaaggacaaccgggagaagaucgagaagauccucaccuuucgcauccccuacuacguggggcccuuggcccggggcaacucccgcuucgccuggaugacgcgcaagagcgaggagaccaucacucccuggaauuucgaggagguggucgacaagggcgccagugcgcagagcuucauugagaggaugaccaacuuugacaagaaccugccgaacgagaaggugcugcccaagcacucccuccuguacgaguacuucacgguguauaacgaacucaccaaggucaaguacgugaccgaggggaugcggaagcccgcuuuccucagcggcgagcagaagaaggccaucguggacuugcuguucaagaccaaccgcaaggucacggugaagcagcucaaggaggauuacuucaagaagaucgagugcuucgacuccgucgagaucagcgggguugaggaccgguucaacgccucccugggcaccuaccacgaccugcucaaaaucaucaaggacaaggacuuucuggacaacgaggagaacgaggacauccuggaggacauugugcucacccugacccuguucgaggaccgcgagaugauagaggagcggcucaagacguaugcccaccuguucgacgacaaggucaugaagcaacugaagcgucggcgcuacaccggguggggccggcucagccgcaaguugaucaacggaauccgagauaaacagagugggaagacaauccuggacuuccuaaagagcgacggcuuugcaaaccgcaacuucaugcagcugauccacgacgacuccuugaccuucaaggaggacauccagaaggcccaaguaucugggcagggagacucccuccacgagcacaucgccaaccuggccgggucccccgccaucaagaagggcauccugcagacggugaaggucguggacgagcuagucaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaagagcaccccguggagaacacccagcuccagaacgagaagcucuaccuguacuaccuucagaacggccgggauauguacgucgaccaggagcuggacauuaacaggcugagcgacuaugacguggaccacaucgugccccaguccuuccucaaagacgacagcaucgacaacaagguccugacacgguccgacaagaaccggggcaagagcgacaacgugcccuccgaggagguagucaagaaaaugaaaaacuauuggagacagcugcucaacgcuaagcugaucacccagcgcaaauucgacaacuugaccaaagccgaacgcgggggccucagcgagcuagacaaggccggguucaucaagcggcagcugguggagacccggcagaucaccaagcacguagcccagauccucgacuccaggaugaacacgaaguacgacgagaacgacaaacugauccgggaggucaaggugaucacccucaagagcaaacuuguguccgacuucagaaaggacuuccaguucuauaagguuagggagaucaacaacuaccaccacgcgcacgacgcauaccugaacgccguggugggcaccgcccugaucaagaaguacccgaaacuugagagcgaguucgucuacggggacuacaagguguacgacgugcgcaagaugaucgcgaaguccgagcaggagaucggaaaggcuaccgccaaguacuucuucuacagcaacaucaugaacuucuucaagacggagaucacccuggcaaacggcgaaauccggaagcgcccccuaaucgaaacgaacggagagaccggcgaaaucgucugggacaaggggcgggacuucgccacggugcgcaaggugcucuccaugccccaggucaauaucguaaagaagaccgaggugcagaccggcggguucagcaaggaguccauccugcccaagcgcaacagcgauaaguuaaucgcgcguaagaaggacugggacccgaagaaguacggcggcuucgacucccccaccgucgcguacagcgugcugguggucgccaagguggagaagggcaagagcaagaaguuaaaguccgugaaggagcugcucgguaucacgaucauggagcgcaguuccuucgagaagaaccccaucgauuuccuggaggccaagggauacaaggaggucaagaaggaccugaucaucaagcuccccaaguacagccuguucgagcuggagaacggccggaaacgcaugcucgccuccgcgggggagcugcagaagggcaacgaacuggcccuccccagcaaguacgugaacuuccuguaccuggccucccacuaugagaaguuaaaaggcagccccgaggacaacgaacagaagcagcuguucguggagcagcacaagcauuaucuggacgagaucaucgagcagauauccgaguucagcaaacgggugauccucgccgacgccaaccucgacaaggugcucuccgcguacaacaagcaccgugacaagcccauccgggagcaggccgagaacaucauccaccucuucacccugaccaaccuuggggccccugccgcguucaaguacuucgacaccacgaucgaccggaagcgguacaccagcaccaaggagguguuagacgcgacccugauacaccagaguaucacgggccuguacgagacccgcaucgaucucagccagcucgggggcgauaagcggcccgccgccaccaagaaggccgggcaggcgaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10363 - RNA, 5379 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10364 - RNA, 3651 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaagugggcauccacggggucccggccgcgaagcggaacuacauccugggccucgacaucgggaucaccagcgugggcuacgggaucaucgacuacgaaacccgcgauguuaucgacgccggcguccggcuguucaaggaggccaacguggagaacaacgaaggccgccgguccaagcgcggggcccggcgccugaagcggcgccggcgccaccggauccagcgcgugaagaagcuccuguucgacuacaaccugcucacggaccacagcgagcugucgggcaucaaccccuacgaggcccgggucaagggucucagccagaagcucuccgaggaggaguucagcgcggcccugcugcaccucgccaagcgcaggggcgugcacaacgugaacgaggucgaggaggacaccgggaacgagcucuccaccaaggagcagaucagccgcaacuccaaggcccuggaggagaaguacguggcggagcuccagcucgagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaagacaucaaggagugguacgagaugcugaugggccauugcaccuacuucccggaggagcuccgaagcgugaaguacgccuacaacgccgaccuguacaacgcgcucaacgaccucaacaaccuggucaucacgcgcgacgagaacgagaagcuggaguacuacgagaaguuccagaucaucgagaacguguucaagcagaagaagaagcccacccucaagcagauagccaaggagaucuuggugaacgaggaggacaucaagggguaccgggucaccuccaccggcaagcccgaguucacgaaccuaaagguguaccacgacaucaaggacaucaccgcccgcaaggagaucaucgagaacgccgagcuccuggaccagaucgccaaaauccugaccaucuaccagagcuccgaggacauccaggaggagcucaccaaccugaacagcgagcugacacaggaggagaucgagcagaucuccaaccucaagggguacaccggcacccacaaccugagccugaaggcgaucaaccucauccuggacgagcuguggcacaccaacgacaaucagaucgccaucuuuaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcuacccaacgacauaaucaucgagcuggcccgggagaagaacagcaaggacgcccagaagaugaucaacgagaugcagaagcgcaaccggcagaccaacgagcgcaucgaggaaaucauccggaccacgggcaaggagaacgcgaaguaccucaucgagaagaucaagcugcacgacaugcaggagggcaagugccuguacucccucgaggccaucccccuggaggaccugcucaacaacccguucaacuacgagguggaccacaucaucccccgcagcguguccuucgauaacagcuucaacaacaaggugcuggucaagcaagaggagaacuccaagaaggggaaccggacccccuuccaguaccugagcuccagcgacuccaagaucagcuacgagaccuucaagaagcacauccucaaccuggccaagggcaaagggcgcaucuccaagaccaagaaggaguaccugcucgaggaacgggacauuaaccgcuucagcgugcagaaggacuucaucaaccggaaccugguggacacgcgcuacgccacccggggccugaugaaccuccugcgcuccuacuuucgcgucaacaaccuggacgugaaggucaagagcaucaacgggggcuucaccuccuuccucaggcgcaaauggaaguucaagaaggagcggaacaagggcuacaagcaucacgccgaggacgcgcugaucauugccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcauaucaaggacuucaaggacuacaaguacagccaucgcguggacaagaagcccaaucgggagcucaucaacgacacacuguacuccacccgcaaggacgacaaggggaacacccugaucgugaacaaccucaacggccuguacgacaaggacaacgacaagcugaagaagcucaucaacaagagccccgagaagcuccugauguaccaccacgacccccagacuuaccagaagcucaagcugaucauggagcaguacggggacgagaagaacccgcuguacaaauacuacgaggagaccggcaacuaccucaccaaguacuccaagaaggacaacgggcccgucaucaagaagaucaaguacuacggcaacaagcugaacgcccacuuggacaucaccgacgacuaccccaacagccggaacaagguggugaagcucucccugaagcccuaccgcuucgacgucuaccuggacaacggcguguacaaguucgucaccgucaagaaccucgacgugaucaagaaggagaacuacuacgaggugaacagcaagugcuacgaggaggcuaagaagcugaagaagaucuccaaccaggccgaguucaucgccagcuucuacaacaacgaccugaucaagaucaauggugagcucuaccgggucaucggcgugaacaacgaccugcugaaccgcaucgaggugaacaugaucgacaucacguaucgggaguacuuagagaacaugaacgacaagcgcccgcccagaaucaucaagaccaucgcguccaagacccagagcaucaagaaguacucaaccgacauccuggggaaccuguacgagguaaagagcaagaagcacccccagaucaucaagaagggcaagcgccccgccgccacgaagaaggccggucaagccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10365 - RNA, 4719 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgcuguucaacaagugcauuaucaucagcaucaaccuggacuucuccaacaaggagaaaugcaugaccaagcccuacagcauaggccuggacaucgggacgaacuccgugggcugggccgugaucacggacaacuauaagguccccagcaagaagaugaaggugcuggggaacacuuccaagaaguacauuaagaagaacuuacugggcgugcugcuguucgacagcggcaucaccgccgaggggcggcgccugaagcggaccgcgcgccggcgcuacacgcggcgccggaaccgcauccuguaccuccaggagaucuucucuaccgagauggccacccuggacgacgcguucuuccagcggcuggacgacagcuuccucgugcccgacgacaagcgcgacuccaaguacccgaucuucggcaaccugguggaggagaagguguaccacgacgaguuccccaccaucuaccaccuccggaaguaccucgccgacagcacgaagaaggccgaccugcgccucgucuaccucgccuuagcgcacaugauuaaguaccggggccacuuccugaucgagggcgaguuuaacuccaagaacaacgacauccaaaagaacuuccaggacuuccucgacaccuacaacgccaucuucgagagcgaccugucccuggagaacagcaagcagcucgaggagaucgugaaggacaagauuuccaagcuggagaagaaggaccgcauccugaagcuguuccccggggagaagaacagcggcaucuucucugaguuccugaagcugaucgugggcaaccaggcugacuuccggaagugcuucaaccucgaugagaaggcaagccuucacuucuccaaggagagcuacgacgaggaccuggagacccuccugggauacaucggcgacgacuauagcgaugucuuccugaaggcuaagaagcucuacgacgcgauccugcuguccggguuucucaccgugacggacaacgagaccgaggcgccccugagcuccgccaugaucaagcgcuacaacgagcacaaggaggaccucgcccuccugaaggaguacauccggaacaucagccugaagaccuacaacgagguguucaaagacgacaccaagaacggauacgccggcuacauugacgggaagacgaaccaggaggacuucuacguauaccucaagaaccugcuggccgaguucgagggcgccgacuauuuccucgagaaaaucgaccgcgaggacuuccugcgcaagcagcgcaccuucgacaacggguccaucccguaccagauccaccuucaggagaugcgcgccauccuggacaagcaggccaaguucuacccuuuccuagccaagaacaaggagcggaucgagaagauccugaccuuccgcauccccuacuaugugggcccgcuggcgcgggggaacagcgacuucgcuugguccauccgcaagcggaacgagaagaucaccccguggaacuucgaggacgugaucgacaaggagagcuccgcugaggccuucaucaaccgcaugacgagcuucgaccucuaccugcccgaggagaagguccugccuaagcacucccuccuguacgagaccuucaacguguacaaugagcugaccaaggugcgguucaucgccgagagcaugcgcgacuaccaauuccuugacuccaagcagaagaaggacaucguccggcuuuacuucaaggacaagcgcaaggugaccgacaaggacaucaucgaguaccugcacgcgaucuacggcuacgacggcaucgaacucaaggggaucgagaagcaguucaacagcagccugagcacguaccacgaccugcucaacaucauuaacgacaaagaguuccuggacgacuccagcaacgaggcuaucaucgaggagaucauccacaccuuaaccaucuucgaggaccgggagaugaucaagcaacgccucuccaaguucgagaacaucuucgacaagagcgugcugaagaagcugagccgucgccacuauaccggcugggggaagcucuccgccaaacuuaucaacggcauccgggacgagaaguccgggaauacaauccuggacuaccucaucgaugacggcaucagcaaucgcaacuucaugcagcugauccacgacgacgcccugagcuucaagaagaagauccagaaggcgcagauuaucggcgacgaggacaaggguaacaucaaggaagucgugaagucccuccccggcagcccggccaucaagaagggaauccugcaguccaucaagaucguagacgagcuggugaaggugaugggcgggcggaagcccgagagcaucgucguggagauggcccgagagaaccaguacaccaaccagggcaaguccaacagccagcagaggcucaagcgccuggagaagucacugaaggagcucggcagcaagauccugaaggagaacauccccgccaagcugaguaagaucgacaacaacgcccuacagaacgaccgccuguaucuguacuaccuccagaacgggaaggacauguauaccggagacgaccuggacaucgaccggcugagcaacuacgacaucgaccacauaaucccccaggcguuccucaaggacaacuccaucgacaacaaggugcuggucagcuccgccagcaaccgcggaaaguccgacgacuucccgagccuggaggugguuaagaagcggaagacuuucugguaccaguugcucaagagcaagcugauuucccagcgcaaguucgacaaccugacgaaggccgaacggggcggccugcugcccgaagacaaggcaggcuucauccaacgccagcucgucgaaacccggcaaaucaccaaacacguggcccgccugcuggacgagaaguucaacaacaagaaggacgagaacaaccgggcggugaggaccguaaagaucaucacgcucaagagcacccuggugucccaauuccggaaagacuucgaguuguacaaggugcgcgagaucaacgacuuccaccaugcccacgacgccuaccucaacgccgucaucgccagcgcgcugcugaagaaguaccccaagcucgagccugaguuuguguacggcgacuacccgaaauacaacuccuuccgugagcgcaagagcgccaccgagaagguguacuucuauuccaauaucaugaacaucuucaagaaguccaucucccuggcugacgggcgggugaucgagcgcccccugaucgaagugaacgaggagacgggcgagagcguguggaacaaggaguccgaccucgccaccguccggcgcgugcugagcuacccccaggugaacgucguaaagaagguggaggaacagaaccacgggcuggaccggggcaagcccaagggccucuucaacgcgaaccuguccagcaagccgaagcccaacuccaacgagaaccuggucggggccaaggaauaccucgaccccaagaaguacggcggguacgccggcaucagcaacuccuucgccgugcuggucaaggggacgaucgaaaagggagccaagaagaagaucaccaacguccuggaguuccagggcaucagcauccucgaccgcaucaacuaccggaaagacaagcugaacuuccuguuagagaagggguacaaggacaucgagcugaucaucgaacugccgaaguacucacucuucgagcuguccgacggcagccgccggaugcucgcgucgauccucagcaccaacaauaagcguggggagauacauaagggcaaccagauuuuccugucccagaaguucgugaagcugcucuaccacgccaagcggaucagcaacaccaucaacgagaaccaccgaaaauacguggagaaccacaagaaggaguucgaggagcuguucuacuacauccuggaguucaacgagaacuacgucggugccaagaagaacggaaagcuccugaacagugccuuccagagcuggcagaaccauucgaucgacgagcuaugcagcuccuucaucggccccacggggagcgagcgcaagggccucuucgagcuaacaucccgggggagcgccgcagacuuugaguuccugggcgugaagauaccccgcuaccgggacuacacccccuccagccuccugaaagacgccacccugauccaccaguccgugacggggcuguacgagacccgcaucgaccucgccaagcugggcgagggcaagaggccggccgccaccaagaaggcagggcaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10366 - RNA, 3795 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcacccaaaaagaaacgcaaaguaggaauacacggagugccggcagcaugguacgcgagccuuaugagcgcccaccaucuacgcguuggaaucgacguaggcacccacagcguaggacuagccacacuccgaguagacgaccacggaaccccaauugaauuacuaucggcacugagccacauccacgauaguggagucgggaaagaaggaaagaaagaccacgacacacgaaagaaacugucaggaauagcaagacgcgcucgaagacuauuacaccaccgacgaacacagcuccaacaacuagacgaaguccuacgagaucuaggcuucccaaucccaacaccgggagaguuccuagacuuaaacgaacaaaccgacccauaccgcguguggcgaguccgagcacgacucguggaagagaaacucccagaggaauuacgcggaccagccauaagcauggcagugaggcacaucgcccgacaccgaggguggaggaacccguauaguaaaguagaaucccuacuaagccccgccgaggaaagcccauucaugaaagcacuccgcgaacgaauccucgcaaccaccggcgaaguacuagacgauggcauaacgccgggccaagcuauggcccaagucgcacugacccauaacaucucaaugcgcggaccagaaggcauacuaggaaaacuacaccaauccgauaacgcaaacgaaauccggaaaauaugugcccgccagggggucagccccgacguuugcaaacagcuacuccgggccguauucaaagccgacucaccuagaggcagcgccgugaguagaguagcacccgauccccuucccggucaggggagcuuccgcagagccccaaaaugcgacccagaguuccagcgcuuccgaauaauauccauaguggcaaaccugcgaauaucugaaacgaaaggcgaaaacagaccacuaaccgccgacgaacgcagacacgucgucaccuuccuaacggaagacagucaagccgaucuuacuuggguggacgucgcagaaaaacucggaguucaccgccgggacuuaaggggaacagccguacacaccgacgacggagaaagaagugccgcccggcccccaaucgacgcaacggauagaaucaugagacagaccaaaaucaguucccucaaaacguggugggaagaagccgacagcgaacagagaggcgcaaugaucagguaccuguacgaagacccaaccgauucugaaugcgcagaaaucauagcugaacucccagaagaagaucaagccaaacuagacucccuacacuuacccgcaggacgcgccgcauacagcagagagagucuaacagccuuaagcgaccacaugcucgcgacaaccgacgaccuccacgaggcacgaaaacgccuuuucggcguugacgacagcugggccccacccgccgaagcaaucaacgcccccgucgggaaccccucgguggaccgcacauuaaaaauaguagggcgauaccucucagcagucgaaucuauguggggcacgccagaagucauucacguagagcacguccgagacggguucacgagcgagcgcauggccgacgaacgagacaaggcaaaccgacgaagauauaacgacaaccaagaagcaaugaagaaaauccagagagacuacggaaaagaaggcuacauauccagaggggacauaguaaggcuggacgcccucgaacuccagggaugugccugucucuacugcgggacaacaauuggauaccacacgugccaacuagaccacaucguaccccaggcaggaccaggaagcaacaaccgccgagggaaccuagucgcuguaugcgaaagaugcaaccgcucgaaaucaaacacccccuuugcaguuugggcccaaaaaugcggcaucccccacgucggaguaaaggaagcgaucggcagagucaggggcuggagaaagcaaacaccaaacacaucaagcgaagaucuuacaaggcuaaagaaggaggucaucgcacgacuaagacgaacacaggaggacccagaaaucgacgaaagguccauggagagcguagccuggauggcaaacgaacuccaccacagaaucgcggccgcauacccagagacaaccguuauggucuauagagguaguaucacagcggcugcacggaaagccgccggaauagacucccgcaucaaucuuauaggagagaagggacgaaaagacagaaucgaccgccggcaccacgccguggaugccuccgucgucgcgcuaauggaggcaagcgucgcaaaaacacuagccgaacgcagcagccugcgcggcgaacagcgccuaaccggaaaagaacagaccuggaaacaauauacaggcaguaccguaggagccagagaacacuucgaaauguggagaggccacaugcuccaccucacggaacuguucaaugaaagacuagccgaagacaaaguuuacguaacacagaacauacgccugcgacucagcgacggcaaugcacacaccgucaaccccagcaaacucguaucacaccgacucggcgacggacucacaguacaacaaaucgaccgcgcgugcacuccagcccuguggugugcccuaacccgagaaaaagacuucgacgagaaaaacggccuaccggcacgagaagaccgggccauccgagugcaugggcacgaaauaaaaucgucagacuacauacaaguguucuccaaaagaaagaaaaccgacucagaccgagaugagacaccguucggagcaauagcgguacguggaggguucgucgagaucggacccagcauccaccacgccagaauauacagaguagaaggaaagaaaccagucuacgcaaugcucaggguguucacacaugaccucuuaagccagcgacauggcgaccuauuuagcgcggugauaccaccacaaaguaucagcaugagaugcgcggaacccaaacuccgcaaagcgauaacaacgggaaacgccacauaucuagggugggucguagugggcgacgagcuugaaauaaacguagacaguuucaccaaauacgcuauuggacgcuuccucgaagacuucccaaacacaacacgauggcgcaucugcgguuacgauacaaacucaaaacucacgcugaagccaaucguccuggccgccgaaggacucgaaaacccguccucagccgucaacgagaucguugaacugaagggauggagaguagcgaucaacguccucacaaaaguccacccaacaguaguccgacgcgacgcacuaggacgaccgcgcuauaguucgagaucaaaccuaccaacaagcuggacgaucgagaaacgcccagccgcaacaaagaaagccggacaagcgaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10367 - RNA, 4656 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccugccgcgaccaagcccuacagcaucggccuggacaucgggaccaacuccgugggcugggccgugacgaccgacaacuacaagguucccagcaagaagaugaaggugcucgggaacacuagcaagaaguacaucaagaagaaccuauuaggcgugcuccuguucgacagcggcaucacggccgaggggcggcgccugaagcggacggcccgcagacgcuacacccggcgccggaaucgcauccucuaucugcaagagaucuucuccaccgagauggccacccuagacgacgccuucuuccaacggcuagacgacagcuuccugguccccgacgacaagcgcgacuccaaauacccgaucuucggcaaccugguggaggagaaggccuaccacgacgaguuccccaccaucuaccaccuccggaaguacuuggccgacagcaccaagaaggccgaccugcgccucguguaccuggcgcuggcccacaugaucaaguaccgggggcacuuucucaucgagggcgaguucaacuccaagaacaacgacauccagaagaacuuccaggacuuccuugacaccuacaacgccaucuucgaaagcgaccuguccuuggagaauagcaagcagcuggaggagauagucaaggacaagaucuccaagcuggagaagaaggaccgcauccucaagcuguuccccggggagaagaacagcggcaucuucuccgaguuccugaaacucaucgugggcaaccaggccgacuuccggaagugcuucaaccuggacgagaaggccagucugcacuucuccaaggagagcuacgacgaggaccucgagacccugcugggguacaucggcgacgacuacuccgacguguuccucaaggcgaagaagcuguacgacgccauccugcucaguggguuucugacggucaccgacaacgagaccgaggcgccccugagcuccgccaugaucaagcgcuacaacgagcacaaggaggaccucgcacugcugaaggaguacauccggaacaucagccucaagaccuacaacgagguguucaaggacgacacgaagaacggcuacgccggcuacaucgacggaaagaccaaccaggaggacuucuacguguaccugaagaagcugcucgccgaguucgagggcgcagacuacuuccuugagaagaucgaccgcgaggacuuccugcggaagcagcgcaccuucgacaacgguuccaucccguaccaaauccaccuccaggagaugcgcgccauccuggacaagcaggccaaguucuaccccuuccuggcgaagaacaaggaacggaucgaaaagauccugaccuuccgcauccccuacuacgucggcccucucgcccgggggaacagcgacuucgccugguccauccgcaagagaaacgagaagaucacgccuuggaacuucgaggacgugaucgacaaggagagcuccgccgaggccuucaucaaucgcaugaccagcuucgaucuguaccuccccgaggagaagguucuucccaagcacucgcugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacauuaucgaguaccuccacgcaaucuacggcuacgacggcaucgagcugaaggggaucgagaagcaguucaacagcucccugagcaccuaccacgaccuccugaacaucaucaacgacaaggaguuccuggaugacuccagcaacgaagccaucaucgaggagaucauccacacccucaccaucuucgaggaccgggagaugaucaagcagcgccugucaaaguucgagaacaucuucgacaagagcgugcugaagaagcucucccggcgccacuacacgggcugggggaagcugagcgccaagcugaucaacggcauccgggacgagaaguccgggaacaccauccucgauuaccugaucgacgacggcaucagcaaccgcaacuucaugcagcugauccacgacgacgcgcucagcuucaagaagaagauccagaaagcacagaucaucggcgacgaggacaaggggaacaucaaggagguggucaagucccugcccggcagcccggccaucaagaaagggauccugcaguccaucaagaucguggacgagcucgucaaggugaugggcgggcgaaagcccgagagcaucguggucgagauggcccgcgagaaccaguacaccaaccagggcaaguccaacagccagcagcggcugaagcgccuggagaagucccucaaggagcugggcagcaagauacugaaggagaacauccccgccaagcucuccaagaucgacaacaacgcgcugcagaacgaccgccuguacuuguacuacuugcagaacgggaaggacauguacaccggcgacgaccuggacaucgaccggcuaagcaacuacgacaucgaccacaucaucccccaggccuuccugaaggacaacuccaucgacaacaaggugcuggugagcuccgcgagcaaccgcgggaaguccgacgacgucccgagccucgagguggugaagaaacggaagacguucugguaccagcugcucaagagcaagcugaucucccagcgcaaguuugacaaccugaccaaagcagagcguggcggccugagccccgaggacaaggccggguucauccaacgccagcucgucgagacccggcagaucaccaagcacguggcgcgccugcuggacgagaaguucaacaacaagaaggacgagaacaaccgggccgugcgcacggucaaaaucaucacccucaaguccacccuggugagccaguuccgaaaggacuucgagcuguacaaggugcgcgagaucaacgacuuccaccacgcccacgacgccuaccucaacgccgugguggcguccgcccugcugaagaaguaccccaagcucgagcccgaguucguguacggcgacuacccgaaguacaauagcuuccgggaacgcaaguccgccaccgagaaggucuacuucuacagcaauaucaugaacauauucaagaaguccaucagccuggccgacgggcgggugaucgagcgcccccugaucgaggugaacgaggagaccggcgaauccgucuggaacaaggagagcgaccucgcgacggugcggcgcguccuguccuacccccaggucaacguggugaagaaggucgaggagcagaaccacgggcuggaccgggggaagcccaagggccucuucaacgccaaccugagcuccaagccgaagcccaacagcaacgaaaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaucgcaucaacuaccggaaggacaagcugaacuuccugcucgagaagggguacaaggacaucgagcugaucaucgagcugccaaaguacagccucuucgagcugagugacggcucccgccgcaugcuggcgagcauccucuccacgaacaacaagcgcggggagauccacaagggcaaccagaucuuccugagccagaaguucgugaagcugcucuaccacgccaagcggaucuccaacaccauaaacgagaaccaccggaaauacguugagaaccacaagaaggaguucgaggagcuguucuacuacauccuggaguucaacgagaacuacgucggggccaagaagaacgggaagcuccugaacagcgccuuucaguccuggcagaaccacagcaucgacgagcugugcucuagcuucaucggccccacaggguccgagcgcaagggccucuucgaacugaccagccggggguccgccgcggacuucgaguuccugggcgugaagaucccccgcuaccgggacuacacgcccagcucccuccucaaggacgcuacccugauccaccagagcgucacggggcucuacgagacccgcaucgaccuggccaaguugggagagggcaagcggccggccgccacgaagaaggcgggucaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10368 - RNA, 3738 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccgaaaaagaaacgcaaagugggcauccacggaguaccagccgcugccgccuucaaaccaaacagcauaaauuauauccucggccuagauaucgguaucgccuccguagggugggccauggucgagauugaugaagaagaaaacccaaucaggcucauagaccuaggcguacgagucuucgaacgcgccgaagucccaaaaacaggagauucccucgcuauggcacgaagacuagcaagaagcgugagacgacuuacccgccgacgcgcccaccgccuccuccgaacucgucgccuccuaaagcgcgaaggaguccuccaagccgccaauuucgacgaaaacggucuaaucaaaagccuccccaacacgccauggcaacuccgagcagcggcccuagaccggaaacuaacaccccuagaaugguccgcuguccuacugcaccucaucaaacaccgcggauaccuaagccagaggaaaaacgaaggagagaccgccgacaaagaacuaggcgcgcuacugaaagguguagcaggcaacgcacaugcccuacagacgggugacuuucgaacaccggcagagcucgcacuuaacaaauucgaaaaagaaucuggacauauccgaaaucaaagauccgacuacagccacacauucagccgaaaagaucuacaagccgaacucauccuucuauucgaaaaacaaaaagaguucggaaauccccacguaucgggcggacugaaggaagggaucgaaacccuacucaugacacaacggcccgcccuaucaggcgaugccguucagaaaaugcuaggccacugcacauucgaaccagccgaaccaaaggcggccaaaaacaccuacacagcggaacgcuucaucugguuaacuaaacugaauaacuuacgcauacucgaacaaggcucugaacgaccccucacggauacagaacgcgcaacccuaauggacgagcccuaccgcaaaagcaaacugaccuaugcacaagcgagaaaacuccuaggacucgaagacacagccuucuucaaaggucucagguacggaaaagauaacgccgaggccagcacacucauggaaaugaaagccuaccaugccaucagccgagcccuggaaaaagagggccucaaagauaagaaaagcccucucaaccuuagccccgaacuucaagaugaaaucggaaccgcauuuagccucuucaaaacagacgaagacaucaccggacgacugaaagaccgcauccaaccagagauacucgaggcgcugcuaaaacacauauccuucgacaaauucguacaaaucagcuuaaaggcacuacgccggauaguaccccuaauggaacaagggaaacgauacgacgaagcaugugccgaaauauacggugaucacuacggaaagaaaaacacugaagaaaagaucuaccucccaccaauacccgccgacgaaauaaggaaccccguaguacuacgugcccucucacaagcacgcaaagucauuaacggaguagucagaagauauggcagccccgcgcggauccacaucgaaacagcccgcgaaguaggcaaaucuuucaaagaucgcaaagaaaucgagaaaagacaagaagagaauagaaaagaucgagagaaagccgccgcaaaauuccgagaauauuuccccaacuucgucggugaaccaaaaaguaaagacauccucaaacuccgccucuaugagcaacagcacggaaaaugccuauacagcggaaaagaaaucaaccucggccggcuaaacgagaagggauacguagaaauagaccacgcccucccauucucgcgaacaugggacgacucuuuuaauaacaaagucuuaguccucggaucagagaaccaaaacaaaggaaaucaaacgccauacgaguacuucaacggcaaggacaacagcagagaauggcaagaguucaaagcacgaguggaaaccucccgauucccacgcuccaagaaacaaagaauccuacuccagaaauucgacgaagacggguucaaagaacgcaaccugaacgauacacgguacgucaaccgcuucuuaugccaauucguggcggaccgcaugcgccucacgggaaaagguaagaaacggguauucgccagcaacggacagauaacgaaccuccuccggggauucuggggccuccgaaaaguccgggcagaaaacgaccgacaccacgcgcuagacgcgguugucguugcuugcagcaccgucgccaugcagcagaaaauaaccagauuugucagauacaaagagaugaacgccuuugacggaaaaacuaucgacaaagagacaggcgaaguacuacaccaaaagacacacuucccgcaaccaugggaguucuucgcccaagaagucaugauaaggguauucgggaaaccagacggcaaaccagaguucgaagaagcagacacccuagaaaagcuccgcacccuacuggcagaaaaguugagcagccgccccgaagccguacacgaauacguaacaccacucuucgucucccgagcacccaaccgaaaaaugagcggccaaggccacauggaaaccguaaaauccgccaagcgccuggacgaaggcgucuccguacuaagaguaccccucacccaacucaagcuaaaagaccuggagaaaaugguuaacagagaaagagaaccaaagcuauaugaggcccucaaggcgcgccucgaggcacacaaagacgacccagcaaaagcauucgcugaacccuucuauaaauacgauaaagccgggaacagaacacaacagguaaaggccguccggguagaacagguacagaagaccggagucuggguccgaaaccauaauggcaucgcagacaacgcaacaaugguacgcgucgauguguucgaaaaaggcgacaaguacuaccuaguacccauauacagcuggcaggucgcgaaaggcauccuaccggacagggccguaguccagggcaaagaugaagaagacuggcagcuaaucgaugauuccuucaacuuuaaauucagccuacacccaaaugaccucguagaaguaaucaccaaaaaggcaagaauguucggauacuucgccagcugccacagaggaaccggaaacaucaacauucggauacacgaccucgaucacaaaauaggcaagaauggcauacucgagggcauaggggucaaaaccgcacuauccuuccagaaguaccaaaucgacgagcuuggaaaagaaauccggcccugucgacugaagaaaaggccaccaguucggaagagaccggccgccaccaaaaaggcaggucaagccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10369 - RNA, 4494 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgaagaagccauacaccaucggccuggacaucgggaccaacagcgugggcugggccgugcucaccgaccaguacgaccuggucaagcggaagaugaagaucgccggggacuccgagaagaagcagaucaagaagaacuucuggggcgugcgccuguucgacgagggccagaccgccgcugaccggcgcauggcgcggaccgcccgccggcgcauugagcggcgccggaaccgcaucagcuaccuccagggaaucuucgccgaggagauguccaagaccgaugccaacuucuucugccggcugagcgacuccuucuacguugacaacgagaagcgcaacagccggcaccccuucuucgcgacgauagaggaggaggucgaguaucacaagaacuaccccacaaucuaccaccuccgcgaggaacucgugaacuccagcgaaaaggccgaccugcgucuaguguaccucgcccuggcccacaucaucaaguaccgcggcaacuuccugaucgagggggcccucgacacccagaacaccuccgucgacggcaucuacaagcaguucauccagacguacaaccagguguucgcguccgggaucgaggacggcucccuuaagaagcuggaggacaauaaggacguggccaagauccucgucgagaaggugacccggaaggagaagcuggagcgcaucuuaaagcucuacccgggcgagaaguccgccgggauguucgcccaguucaucagccuaaucgugggcagcaaggggaacuuccagaagcccuucgaccugaucgagaaguccgacaucgagugcgccaaggacucguacgaggaggaccucgagucccugcuggcgcucaucggggacgaguacgccgagcuguucgucgccgccaagaaugccuacagcgcgguggugcugaguagcaucaucaccgucgccgagaccgagacgaacgccaagcucagcgccuccaugaucgagcgguucgacacccacgaggaggaccugggcgagcugaaggcauucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaagagaacuuccugcgcaagcagcgcacauucgacaacggggcgauuccccaccaacugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgauuuuggcaaguccgccguagacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccucguauuucagcggccaggagaaggagcagaucuucaacgaccuguucaagcagaagcggaaggucaagaagaaggaccucgagcuguuccugcguaacaugucccacguggagagccccacgaucgaggggcuggaggacuccuucaacagcuccuacagcaccuaccacgaccuccugaaggugggcaucaagcaggagauccuggacaaccccgucaacacagagaugcucgagaauaucgugaagauccugacaguguucgaggacaagcggaugaucaaggagcagcugcagcaguucuccgacguucucgacggcguggugcugaagaagcuggagcgccggcacuacacgggguggggccgccucagcgccaagcugcugauggggauccgggacaaacagucccaccucaccauccuggacuaccugaugaacgacgacggccucaaucgcaaccugaugcagcugaucaacgacagcaaccuuucauucaagagcaucaucgagaaggagcaggucaccaccgccgacaaggauauccagagcaucguggccgaccuggcgggauccccggccaucaagaagggcauccugcagagccucaagaucguggacgaacuggucuccgugaugggcuacccgccccagacgaucguggucgagauggcccgggagaaccagacuaccgggaagggcaagaauaacagccgcccccgguacaagucccuggagaaggccaucaaggaguucgggagccagauccuuaaggagcaccccaccgauaaucaggagcugcgcaacaaccgacuguaccucuacuaccugcagaacggcaaggacauguacacgggccaggaccuugacauccacaaccucuccaacuacgacaucgaccauaucgugccccagagcuucaucaccgacaacuccaucgacaaccuggugcugaccagcuccgccgggaaccgcgaaaagggcgacgacgucccgccccucgagaucgugcgcaagcgcaagguguucugggagaagcuguaccaggggaaccugaugagcaagcgcaaguucgacuaccugaccaaggcggagcggggcgggcugaccgaagccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccaacucuacaaggugcgcgacgucaacgacuaccaccacgcccacgacgccuaccugaacggcguuguggcgaacacucugcucaaggucuacccccagcuggagcccgaguucguguacggggacuaccaccaguucgacugguucaaggccaacaaggcgaccgccaagaagcaguucuacaccaacaucauguuguucuucgcccagaaggaccggaucaucgacgaaaacggugagauccucugggauaagaaguaccuggacaccgugaagaaggucauguccuaccgccagaugaacaucgugaagaagacggagauccagaagggggaguucucgaaggccaccaucaagcccaagggcaacuccagcaaguuaaucccccggaagaccaacugggacccgaugaaguacgggggccucgacagccccaacauggccuacgcgguugucaucgaauacgccaagggcaagaacaagcugguguucgagaagaagaucauccgcgugaccaucauggagcggaaggccuucgagaaggacgagaaggccuuccuggaggagcagggguaccgccagccgaagguccucgccaagcugccgaaguacacgcuguacgagugcgaggagggccggcgccggaugcucgcguccgcaaacgaggcccagaaggggaaccagcagguccugcccaaccaccuggugacccuccugcaccacgccgcgaacugcgaggugagcgacggcaagucccuggacuacaucgagagcaaccgcgagauguucgcggaacuccuggcccauguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaauucuucgagaccacgaucgagcgcaagcgguacaacaaccucaaggagcugcugaacagcaccaucaucuaccaauccaucaccggccucuacgagucucgcaagcgccucgacgacaagcggcccgccgccaccaagaaggcagggcaggcgaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10370 - RNA, 4527 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcucccaagaagaaacgcaaggugggcauccacggggucccggcagcgaagaagcccuacagcaucggccuggacaucggcaccaauuccguggguugggccgugguaaccgacgacuacaaggugcccgccaagaagaugaaggugcucgggaacacggacaagagccacaucgagaagaaccugcugggcgcccuacuguucgacuccggcaauaccgccgaggaucggcgccuaaagcggaccgcgcgcagacgauacacccggcgccggaaccgcauccucuaccuucaggaaaucuucucagaggagaugggaaaggucgacgacuccuucuuccaccggcuggaggacagcuuccucgugacggaagacaagcgaggcgagcggcaccccaucuucgggaaccuggaggaggaagugaaguaccaugagaacuucccgaccaucuaccaccuccgccaguaccuggccgacaaucccgagaagguugaccugcggcugguguaccucgcccuggcccacaucaucaaguuccgcgggcacuuccugauugaggggaaguucgacacgcggaacaacgacgugcaacgccucuuucaggaguuccuggcggucuaugauaacacguucgagaacuccagccuucaggagcagaacguccagguggaggagauccucaccgacaagaucucuaaaagcgccaagaaggaccgggugcugaagcuguuccccaacgaaaaguccaacggccgcuucgccgaguuccucaagcugaucgugggcaaccaggccgacuucaagaagcauuucgagcuggaggaaaaggccccgcuacaguucaguaaggacaccuacgaggaggagcuggaggugcugcucgcgcagauaggugauaauuacgccgagcuguuccuguccgccaaaaagcuguacgacagcauccugcuguccggcauucuaacagucaccgacgugggaacgaaggccccgcuuagugcuucaaugauccagcgguauaacgaacaccagauggaccuggcgcagcuaaagcaguucauaagacagaagcugagcgacaaguacaacgaaguguucuccgacgucagcaaggacggcuaugccggcuacaucgacgggaagaccaaccaggaggccuucuacaaguaccugaaggggcuccugaacaagauagaggggagcggcuacuuccuggacaagauagagcgcgaggacuuccuacggaagcagcguacuuucgacaacggguccauaccccaccagauccaccuccaggagaugcgggccaucauccgccgucaggcagaguucuaccccuuccucgcggacaaccaggaccgcaucgagaagcugcugaccuucagaauccccuacuacguggggccgcuggcccgcggcaagagcgacuuugccuggcugucccguaagagcgccgacaagauaacgcccuggaacuucgacgagaucguugacaaggagagcagcgccgaggcguucaucaacagaaugaccaacuaugaccucuaccuccccaaccagaagguccugcccaagcacucccuccuauacgagaaguucaccgucuacaaugagcugaccaaggugaaguacaaaacggagcaagggaagaccgcguucuucgacgcuaacaugaagcaagagaucuucgacggcguuuucaaaguguaccggaaggucacuaaagauaagcucauggacuuccuggagaaggaguucgacgaguuccgcaucguggaccugaccggucuggacaaggaaaacaagguguuuaacgccagcuacggcacguaccacgaccugugcaagauacucgauaaggacuucuuagauaacuccaagaacgagaagauccuggaggacaucguccugacccucacucuguucgaggaccgggagaugauccgcaagcggcuggagaacuauagcgaccuccugacaaaggagcaggucaagaagcuggagcgccggcacuacacuggguggggucgcuuguccgcggagcuaauccacggcauccggaacaaggagagcaggaagaccauccuagacuacuuaaucgacgacgggaacuccaacaggaacuucaugcagcugaucaacgacgacgccuugucuuuuaaggaggaaaucgccaaggcccaggugaucggcgagaccgacaaccucaaccaagugguguccgacaucgccgggucuccggcgaucaagaagggcauccugcagucccugaaaaucguggacgagcucgucaagaucaugggccaccaacccgagaacaucgugguggaaauggcccgugaaaaccaguucaccaaucagggucgccggaacagccagcagcgacugaagggccugacggacuccaucaaggaguucgggagccagauccucaaagaacacccagucgagaacagccaacugcagaaugaccgacuguuccucuacuaccugcaaaacgggcgcgacauguacaccggggaggagcuggacaucgacuaccucucccaguacgauaucgaccacauaaucccccaagccuucaucaaagacaacagcaucgauaaccgggugcugaccuccagcaaagagaacaggggcaaguccgaugacguacccagcaaggacgucgugcggaagaugaaguccuacuggagcaagcugcucuccgccaagcugaucacccagcgcaaguucgacaacuugacgaaggcugagcggggcgggcucaccgacgacgacaaggcgggcuucaucaagcgccagcuuguggagacccggcagaucaccaagcacguugcccggauccuggacgagcgguucaacaccgagacggacgagaacaauaagaaaauccgccaggugaagaucgugacccucaagagcaaccuggucuccaacuuccggaaggaguucgaacuguacaagguccgagagauaaaugacuaccaccacgcccacgacgccuaccucaacgccgugaucgggaaggcgcugcugggcgucuacccccagcucgagcccgaguucguuuacggggacuacccccacuuccacggccacaaggagaacaaggccaccgccaagaaguucuucuacagcaacaucaugaacuuuuucaagaaggacgaugugcggacugacaagaacggcgagaucaucuggaagaaagacgaacacauaaguaacaucaagaagguccugagcuacccccaggugaacaucguuaaaaaggucgaggagcagaccggaggcuucuccaaagagucgauccuccccaaggggaacuccgacaaacuuaucccccgcaagacgaagaaguucuacugggacaccaagaaguacggcggguucgacagccccauaguggccuacagcauccuggugaucgcagacaucgagaagggcaaguccaagaaacugaagaccgucaaggcacucgugggcguaacgauaauggaaaagaugaccuucgagcgggacccggucgccuucuuggagcgcaagggguaucgcaaugugcaggaggagaacaucaucaagcugcccaaguauagccucuucaagcucgagaacgggcggaagcgccugcuagccuccgccagggagcugcagaaggggaacgaaaucgugcugcccaaccaccuuggaacccuguuauaccacgcgaagaacauccacaaggucgaugagccgaagcaucucgacuacguggacaaacacaaggaugaguuuaaggaacugcuggacguggucucaaacuucuccaagaaguacacccucgccgaggguaaucuagagaagaucaaggagcuguaugcccagaacaacggcgaggaccucaaggagcucgcuagcaguuucaucaaccuucucacuuucacggccaucggggcgcccgccaccuucaaguucuucgauaagaacaucgaccgcaagcgguacaccagcacgaccgagauccugaacgccacgcuuauccaccaguccauaaccggacucuacgagacgcgcaucgaccugaacaagcugggcggggacaagcggcccgccgccaccaagaaggcgggccaagccaaaaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10371 - RNA, 3660 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccuaaaaagaaacggaaagugggcauacacggcguuccagccgcacaaacaaccaaccucaguuacauacuaggucuagaccucgguaucgcaucagucggcugggccgucgucgaaaucaacgaaaacgaagaccccaucggacuaauagacgucggcguaaggauauucgaacgcgccgaagucccaaaaaccggagaaagccuagcacuguccaggagacucgcgcggaguacccgccgccuaauacgccgccgagcccaccgccuacuccucgcgaaacgcuuccucaagagagaaggcauacugagcaccauagaccucgagaaaggccugccaaaccaggccugggagcuaagagucgccggccucgaaaggcgacuaucggccaucgaauggggagccguucuccugcaccuaauaaaacacaggggguaccuaucgaaaagaaagaacgagagucaaacgaacaacaaggagcugggcgcccugcuaagcggaguggcgcaaaaccaccagcuccuacaauccgacgacuaccgaacacccgcagaauuagcccucaagaaauuugcaaaagaagaggggcacauaagaaaccaacgcggcgcuuacacacacaccuucaauagauuagaccucuuagcagaacugaaccugcuauucgcacaacagcaucaauucggaaacccacacuguaaagagcacauccagcaauacaugacugaacuccuaauguggcagaaacccgcacucaguggcgaggccauccuaaaaaugcucggaaaaugcacacacgagaaaaacgaguucaaagccgcgaaacauaccuacagcgccgaacguuuuguuuggcucaccaaacucaauaaccuucgaauacucgaagacggggccgaacgggcacuaaacgaagaagaaagacaacuacuaaucaaccacccguacgaaaagagcaaacuaacauacgcgcagguacgaaaauuacuaggccucuccgaacaagcuauuuucaagcaccuacgcuacaguaaagaaaacgcagagucagccaccuucauggagcucaaagccuggcacgccauacgaaaagcacucgaaaaccagggccugaaggacaccuggcaggaccucgccaagaaacccgaucuccucgacgaaaucggaaccgccuucucacucuacaaaacagaugaagacauccaacaauaccuaacgaacaaaguacccaacagcguaauaaacgcacuacucguaucccugaacuucgauaaguucaucgaacucagccugaaaagccugagaaaaauacuuccucuaauggaacaaggcaaacgcuacgaucaggccugccgcgagaucuacggacaucacuacggggaggccaaccaaaagacgucacaacuccugcccgccauuccagcccaagaaauacgcaaccccguaguccugcgaacgcugucccaagcaagaaaaguaauaaacgccaucauacgacaauacggcucccccgcccgaguccacauagaaacgggucgagaacuagggaaauccuucaaagaacgacgcgaaauccaaaaacagcaggaggauaaucgaaccaaacgcgagucagcgguucaaaaguucaaggaacucuucuccgacuucagcagcgaaccaaaaucuaaagacauacucaaguuccgccuuuacgagcaacaacacgguaaaugccuauacucgggcaaagaaaucaacauacacaggcugaacgaaaaaggauacgucgagaucgaccacgcacuacccuucagucggaccugggacgacucauucaacaauaaaguacuuguccuagcaagcgagaaccaaaacaaaggcaaccagacaccauacgaguggcuacaagggaaaauaaacuccgaacgcuggaaaaacuucgucgcacugguacucggcagccagugcucagccgcgaagaaacaacgccucuugacccaggucauugacgacaacaaauuuaucgaccgcaaccuuaacgacacucgauacaucgcacgcuuccuaucaaacuacauccaggaaaaccuccuacucgucggcaaaaacaaaaagaacguauucacgccaaacggccaaaucacagcccugcuccggucgcgauggggacuaaucaaagcucgagaaaacaacaaccgacaccaugcccuagaugcgaucguggucgcuugcgcgacccccucaaugcaacagaaaauaacccgcuucauccgauuuaaagaaguccaccccuacaaaauagaaaaccgauacgaaauggucgaccaagagaguggagaaauuauaagcccccacuuccccgagccaugggcauacuucaggcaagagguaaacauccgaguauucgacaaccaccccgacacggugcuaaaagagaugcucccggaccggccacaggcaaaccaccaauucguacaaccucuauucgucucccgagcgcccaccagaaaaauguccggccaaggccacauggaaaccaucaaguccgccaaacggcuggcagaaggcaucuccguacuccgaauaccccuaacucaacucaaacccaaucuccuggaaaacaugguaaauaaggagcgcgaacccgcccuguacgcaggccuuaaagcccgacucgccgaguucaaccaggaccccgcaaaagccuucgccacaccauucuacaaacaaggcggccagcagguaaaagcaauccgaguagagcaaguacaaaaaucaggaguccuaguacgcgaaaacaacggagucgccgacaaugccucaaucguacgaaccgacguauucaucaaaaacaacaaauucuuucucguccccaucuacacguggcaaguagcaaagggaauccuaccaaacaaggcaaucgucgcacacaaaaaugaagacgaaugggaagaaauggacgaaggugccaaauucaaguucucucucuuccccaacgaccuugucgaacuaaaaaccaagaaagaauacuucuucggcuacuacaucggacuggaccgggcaacagggaacauaagccuaaaagagcacgacggcgaaaucuccaaaggcaaagacggagucuacaggguaggcgucaaacuugcacugagcuuugaaaaauaccaaguagaugagcuugggaaaaaccgacaaaucugccgaccccaacaaagacaaccugucagaaagagaccagccgcaacuaaaaaggcaggacaagccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10372 - RNA, 3738 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcacccaaaaagaaacgcaaagucggaauccacggaguaccagcagcagccgccuuuaaaccaaacccaaucaacuacauacucggauuagacauagggauagcaucagucggaugggccauggucgagaucgacgaggacgaaaaccccauaugccucauagaccuggggguuaggguuuucgagcgugcagagguuccaaaaacaggcgacagccuagcaauggcacguagacuagcgcgcucuguccgcagacucacgagacgacgggcccacagacugcuaagagcccgccgccugcucaaaagagaaggaguccuacaagccgccgacuuugacgaaaacggacucauaaaaagccuccccaacacacccuggcaacuucgggcggccgccuuagaccgaaaacucacaccccucgagugguccgccgugcuacugcaccugaucaaacaucgaggauaccucagccaacgcaaaaacgagggagaaacggcagacaaagagcucggcgcacugcuuaaaggcguagcggacaacgcacacgcacuacagacgggggacuuccgcacgccagccgagcucgcacucaacaaauucgagaaagaaagcggucacauccgaaaccagcgcggagacuacucccacacauucucccgaaaagaccugcaagccgaacucauccuacuauucgaaaaacagaaagaguucggcaacccacacguaucaggcggucuaaaagaagguauagaaacacuccucaugacccaaagaccggcccugucaggagacgcaguccagaaaaugcucgggcauugcacauucgaaccagcagagcccaaggcagcuaaaaacacauacaccgcagaacgauucaucuggcugaccaagcucaacaaccucagaauauuagaacaagggucugaacgcccccugacugacacggaacgcgcaacacucauggacgaaccguaccgcaaaagcaaacucaccuacgcacaagcccguaaacuacugggccucgaagacacagcuuucuucaagggucugcgauacggaaaagacaacgcagaagcaucaacauuaauggaaaugaaggcuuaccaugccaucagccgagcccuagaaaaggaaggccuaaaagauaagaaaaguccccuaaaccugucgcccgagcuacaagaugaaaucggcacagccuucucgcuuuuuaaaaccgacgaggacaucacagggcgacucaaagaccgaauacaacccgagauucuggaggcgcuccucaaacacauaucauucgacaaauucguccaaauaucccucaaagcacuacgcagaaucguuccucucauggaacaaggcaaacgcuacgaugaagccugcgcagaaauauauggagaccauuacgggaaaaagaacaccgaagagaaaaucuaucugcccccgaucccagcggacgaaauacggaaucccgucguucugcgagcgcuaucccaagcgagaaaaguaaucaacggggucgucagacgcuacggcagucccgcaagaauacacauagaaaccgcccgagaggucggcaaauccuucaaagaccgcaaagagaucgaaaaacgccaagaagaaaaucgcaaggaccgagaaaaagcggcagcgaaauucagagaauacuucccaaacuucgucggggaacccaaauccaaagauauccuaaaacuccgccuauaugaacaacagcauggcaaaugccucuacagcgguaaggaaaucaacuuaggaagacugaacgaaaaaggcuacguggaaauagaccacgcgcucccauucagccgcacuugggacgacucauucaacaacaaagugcugguccucggcucagagaaccagaauaaagggaaucaaacccccuacgaauacuucaacggcaaagacaacagccgcgaauggcaagaguucaaggcacgaguggagaccucgcgcuuccccagaagcaagaaacagcgaauacuccuacagaaauucgacgaagauggcuucaaagaaaggaaccuaaaugacacacgcuacguaaaccgcuuucuuugccaauucguagcagaccggaugcggcucacuggaaagggcaaaaagagagucuucgcauccaacggacaaaucacuaaccugcugaggggauucuggggauuacgcaaaguccgggcagagaacgaccgacaccaugcgcucgacgccguagucguagcaugcagcaccguagccaugcaacagaaaaucacgcgcuucgugagauacaaggaaaugaacgcauucgacggaaagaccaucgacaaagagaccggagaaguccuacaccagaagacccauuucccccaacccugggaguucuucgcccaggaagucaugauacgcgucuucggcaaacccgacggaaagccagaguucgaagaagcggacacgccagaaaaacuaagaacgcugcucgccgagaaacuuagcuccagaccugaagcaguacaugaauauguaaccccacucuucguaagccgagccccgaaccgcaaaauguccggccaggggcacauggaaacaguaaaaucagccaaacgccuagacgagggcgugagcguacuaaggguaccgcuuacacaacucaagcuaaaagaccuagagaaaauggucaaccgcgagcgcgaaccaaagcucuacgaggcccuuaaggcucggcuagaggcacacaaagacgacccagccaaagccuucgcggaaccguuuuacaaauacgacaaggccggcaaucggacucaacaagucaaagccguaagaguagagcagguccagaaaacaggcgucuggguacguaaccacaacggcauagcagacaacgccacuaugguacgcgucgacguguucgaaaaaggcgacaaauauuaucuagugcccauauacagcuggcaagucgcaaaaggaauccuaccagaccgcgcggugguccaaggaaaggacgaagaagacuggcaacucaucgacgacagcuucaacuucaaauucagccuacaccccaacgaccuagucgaagucaucacaaagaaggcccggauguucggguacuucgccuccugccaccgcggcaccgguaacauaaacauaaggauccaugaccucgaccacaaaauaggcaaaaacggaauauuagaaggcaucgggguaaaaacagcccuuagcuuccaaaaauaccaaauagacgagcuaggaaaagaaauaaggcccugccgacucaaaaagagaccaccagugcgcaaaaggcccgcagcaacgaagaaagccggccaagccaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10373 - RNA, 3744 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccgaagaagaaaaggaaagucggcauucacggagucccagccgcaaaauaccauguaggcauagacguaggaacauucagcguagggcucgcggcaauagagguagacgacgcagguaugcccaucaaaacccuaagccuugugucacacauccacgacagcggccucgauccagaugaaaucaaaucggcggucacgcgacuagcaagcagcgguaucgccagacgaacgcgcagacuguaccgaaggaaaaggagaagacuccagcaacuggacaaauucauacaacggcaaggauggccagugauagaauuagaggacuacagcgacccacuauaccccuggaaaguaagagccgagcucgcagcaaguuacauugcggaugagaaagaacgaggcgagaaauugagcguggcacugagacauaucgccagacacagaggauggcgcaacccauacgcaaaaguaagcagccuauaccucccagacgggccguccgacgcauucaaagcgaucagagaagagauaaagagggcgagugggcaaccagugccagaaacagccacggugggacaaauggugacccuaugcgaacuaggcacgcugaagcuaagaggagaaggcggaguccugagugcacgguugcagcaaagcgacuacgcccgcgaaauacaagaaauaugccgcaugcaagaaauagggcaagaacucuacagaaaaauaaucgacguaguauucgcagcugaaagcccaaaggggagcgccagcagccgaguaggaaaagaccccuuacaacccgggaaaaaccgcgcgcuaaaggccagcgacgcauuccaacgauacaggauagcagccuuaauaggaaaccuaagaguccgaguagauggagagaaacgcauccucagcguagaggagaagaaccucguguucgaccaucuggucaaucuaaccccaaagaaagaaccagaauggguaacgaucgcagaaauacugggcauagacagagggcagcuaauaggaaccgccacgaugacggacgacggagaacgcgcgggagcccgaccaccuacgcacgacacgaacagauccaucgugaacagccgaauagccccgcuagucgacugguggaaaacagcgagcgcccucgaacaacaugcaauggucaaggcucuaagcaacgcggaaguagacgacuucgacucaccagagggagcaaaaguccaagcauucuucgccgaccuagacgacgacguccacgcaaaacucgacucccuucaucugccagucggacgagcggcguacagcgaagacacccuaguacgauuaacacgacgcaugcuaagcgacggaguagaucuguacaccgcaagacuacaggaguucggcauugaaccaagcuggacgccaccaacccccaggaucggagaaccaguugguaacccagcuguagaccgaguacuaaaaacagucagucgauggcuugaaagugcgaccaagacuuggggagcaccagaacgggucauaauagaacacguaagggagggauuuguaacagaaaaacgggcgcgagaaauggacggggacaugcguagacgagcagcaaggaacgcaaaacuguuccaggaaaugcaggagaaacuaaacguacaaggaaaacccucuagagcagaucucuggcgguaccagagcguccaaagacaaaacugccaaugcgcauacugcggcagcccaaucacguucagcaacucagaaauggaccacaucgugccaagggcugggcagggauccaccaacacgcgcgagaaccuaguggcggugugccacagguguaaccaaagcaaaggaaacaccccguucgcgauaugggcgaaaaacaccuccauagagggcguaagcguaaaggaagcuguggaaagaacacgacacugggucacggacacaggaaugcgcucaaccgacuuuaagaaauuuacaaaggcugucgucgagagguuccaaagagcaacgauggacgaagagauagacgcaaggagcauggaaucggucgcauggauggcaaacgaauugcgcagucggguagcacagcacuucgcuagccacggaacaacgguacgagucuaccgcggaagccucacagcggaagcacggagggccagcggcauaagcggcaaacuaaaguucuucgacggagucgggaaaucucgccuagaccgcagacaccaugccauagacgcggccgugaucgcauucacaagugacuacguggccgagacccuagcaguacgaagcaauuugaagcaaagccaagcgcacagacaggaagccccgcaauggcgagaguucacaggaaaagacgcagaacacagagcggcauggaggguauggugccagaaaauggaaaaacuaagcgcauugcucaccgaagaccucagggacgacagagucgucguuaugagcaacgugcggcuacgccucggcaacggcucggcccacaaagaaacaauaggaaaacucagcaaggucaaacuaagcucacaacuguccguauccgacauagacaaagcgucgagcgaagcacucuggugcgcgcuaacgcgagaacccggauuugaccccaaggaaggccucccugcaaacccagaacggcacauacgaguaaacgguacacacguguaugcuggugacaacaucggauuauucccagucucagcaggaaguauugcgcugcggggaggauacgcagaacucggcucaaguuuucaccacgcaaggguauauaaaauaacaagcgggaagaaaccagcauucgcuauguugagaguauacacgauagaccugcuccccuaccgcaaccaagaccuauucagcguugaacuaaaaccacaaacaaugucaaugaggcaagccgaaaagaaacugcgagacgcccucgccaccgggaacgccgaauaccucggcugguuagucgucgacgacgagcucguaguagacaccagcaaaauagcaacggaccaaguaaaagcagucgaagcggagcuaggaacgauaagacgauggaggguagauggauuuuucagcccaagcaaacuacgccuaagaccgcuucaaaugucaaaagaaggcaucaaaaaggaaagcgcaccagagcugagcaagauaaucgacagacccggcuggcuaccagcaguuaauaaacucuucagcgacggcaacgucacagucgugcgaagggacucguuggggcggguacggcuagaaagcacagcgcaccuacccgucacauggaagguacaaaagagaccagccgcgacgaagaaggcaggccaggcgaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10374 - RNA, 3444 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaaacgcaaggugggcauccacggggucccggccgcggcccggauacuggccuucgacaucggcaucagcuccauagggugggccuucagcgagaacgacgagcucaaggacugcggcgugcgcaucuucacuaagguggagaaccccaagacaggagagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgaugagagccucgccaaggccuacaaaggcucccugaucagccccuacgagcugcgguuccgcgcacucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguacuuguacaaggaguacuuccagaaauucaaggagaacagcaaggaguucacgaacgugcgcaacaagaaggaguccuacgagcggugcaucgcccagagcuuccugaaggacgagcugaagcucaucuuuaaaaagcagcgcgaguucggguucuccuucagcaagaaguucgaagaggagguccuuuccguggcguucuacaagcgggcucugaaggacuucagccaccucgugggcaacugcuccuucuucaccgacgagaagcgcgccccgaagaacagcccccuggccuucauguuugucgcccugacccggaucaucaaucuccugaacaaccugaagaacaccgagggcauccucuacacgaaggacgaccugaacgcgcugcuuaacgaggugcugaagaacggcacccugaccuacaagcagaccaagaagcuccuggggcugagcgacgacuacgaguucaaaggggaaaagggcacguacuucaucgaguucaagaaguacaaggaguucauuaaggcccucggggagcacaaccugucccaggacgaccugaacgagaucgccaaagacaucacccucaucaaggacgagaucaagcugaagaaggcccuggccaaguacgaccucaaccagaaccagaucgacagcuuauccaaacuugaguucaaggaccaccucaacaucagcuucaaggcgcuaaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgugcgaucaaggaguaccgcaaggugcugaacgcccuccugaagaaguacggcaaggugcacaaaaucaacaucgagcuggcgcgggaggucgggaagaaccacucccagcgcgccaagaucgagaaggagcagaacgagaacuacaaggccaagaaagacgcggagcucgagugugagaagcugggccugaagaucaacagcaagaacauccucaagcugcggcuguucaaggagcagaaggaguucugugccuacuccggggagaaaaucaagaucagcgaccuccaggacgagaagauguuagagaucgaccacaucuacccauacucccgcagcuucgacgacuccuacaugaacaaggugcugguguucaccaagcagaaccaggagaagcucaaccagacccccuucgaggccuucggcaacgacagcgcgaaguggcagaagaucgagguccuggcaaagaaccuacccaccaagaagcagaagcggauccucgacaagaacuacaaggacaaggagcagaagaacuucaaggaccgcaaccugaacgacacacgguacauagcucgccuggugcucaacuacaccaaggacuaccuggacuuccugccgcucuccgacgacgagaacaccaagcugaacgacacccagaaggggagcaaggugcacgucgaggccaaguccggcaugcugacgagcgcucuccggcacaccuggggcuucuccgccaaggaccgcaacaaccaccuccaccacgccaucgaugcggugauaaucgccuacgccaacaacagcaucgucaaggccuucuccgacuucaaaaaggagcaggagagcaacagcgcggagcuguacgccaagaagaucuccgagcuggacuacaagaacaagcggaaguucuucgagcccuucagcgguuuccgccagaaggugcuggacaagaucgacgagaucuucguguccaaacccgagcggaagaagcccagcggugcccugcacgaggagaccuuccguaaagaggaggaguucuaccaguccuacgggggcaaggaggggguccucaaggcgcuggagcugggcaagauccggaaggugaacgggaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguuuugcuucucccucuacaaggacagccugauccugauccagaccaaggacaugcaagagcccgaguucguguacuacaacgccuucaccuccucaaccgugucccucauaguuagcaagcacgacaacaaguucgagacgcuguccaagaaccagaagauccuguucaaaaacgcaaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10375 - RNA, 3855 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgucggaccuaguucucggccuggacaucgggauuggcuccgugggggucgggauccugaacaaggugaccggcgagaucauccacaagaacagccggaucuuccccgccgcccaggccgagaacaaccuagugcgccggacgaaccgccagggccggcgccuggcccggcgcaagaagcaccggcgcguccggcugaaccgccucuucgaggaguccggccugaucacggacuucaccaagaucagcauaaaccugaaccccuaccaguuacgggugaaggggcugaccgacgaacuguccaacgaggagcuguucaucgcgcugaagaauauggugaagcaccgcggcaucagcuaccuggaugacgccuccgacgacgggaacagcuccgucggcgauuacgcccagaucgugaaggagaauagcaagcagcucgagaccaagacgcccggacagauccagcuggagcgguaccagaccuacgggcagcugcgcggcgauuucaccguggagaaagacgggaagaagcaccgacucaucaacgucuucccgaccuccgccuaccgaagcgaggcgcugcggauccugcaaacucagcaggaguucaacccccagaucaccgaugaguucaucaaccgcuaccucgagauccugaccggcaagcggaaguacuaccacggccccgggaacgagaagucccgcaccgacuacggccgcuaucggacgagcggggagacccuggacaacaucuucggcauccucaucgggaagugcaccuucuaccccgacgaguuccgcgccgccaaggccuccuacaccgcccaggaguucaaccuuuuaaaugaccucaacaaccugacggugccgaccgaaaccaagaagcucagcaaggagcagaagaaccagaucaucaacuacgugaagaacgagaaggcuaugggccccgccaagcuguucaaguacaucgccaagcuccuguccugcgacgucgccgacaucaagggcuaccggaucgacaagagcgggaaggccgagauccauaccuucgaggcguaccgcaagaugaagacgcucgagacccuggacaucgagcagauggacagagagacccuggacaagcucgccuacguacugacccugaacacggagcgcgagggcauccaggaggcccucgagcacgaguucgccgacggguccuucagccagaagcaggucgacgagcuggugcaguuccggaaggccaacagcuccaucuucggcaaaggguggcacaacuuuagcgugaagcugaugauggagcucauccccgagcuguacgagaccagcgaggagcagaugaccauccugacccgccucggcaagcagaagacaaccagcuccagcaacaagacuaaguacauugacgagaagcugcugaccgaggaaaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccucacagcguguuccacggccacaagcagcuggccaccaagauccggcuguggcaccagcagggcgagcgcugccucuauaccggcaagaccaucuccauccacgaccugaucaacaacagcaaccaguucgaggucgaccacauccugccccucuccaucacguucgacgacagccuggccaacaaagugcugguguacgcgaccgccaaccaggagaaggggcagcggacgcccuaccaggcccuggacuccauggacgacgccuggucguuccgcgagcugaaggccuucguccgggaguccaagacccugagcaacaagaagaaggaguaccucuugaccgaggaggacaucuccaaguucgacgugcgcaagaaguucaucgagcggaaccucguggacacgcgcuacgcgagccgggucgugcucaacgcccugcaggagcacuuccgcgcccauaaaaucgacaccaagguguccguggugcgcggccaguucaccagccaguuaagacgccacuggggcaucgagaagacccgggacacguaccaccaccaugcaguggacgcccucaucaucgcggccuccucccagcugaaccuguggaagaagcagaagaacacccucgucagcuacuccgaggaccagcugcuggacaucgagaccggggagcucaucagcgacgacgaguacaaggaguccguguucaaggcccccuaccaacauuucguggacaccuuaaagagcaaggaguucgaggauuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccucgagaacuaccccaacaagcagaucaacgagaagggcaaggagguucccugcaacccguuccucaaguacaaggaggagcacggguacauccggaaauacagcaagaagggcaacgggcccgagaucaagucccugaaguacuacgacagcaagcugggcaaccacaucgacauuacccccaaagacuccaacaacaaggugguccuccagagugugucccccuggcgcgccgacguguacuucaacaagaccaccgggaaguacgagaucuugggccugaaauacgcggaccuccaguucgagaagggcacggggaccuacaagaucagccaggagaaguacaacgacaucaagaagaaagagggcgucgacagcgacuccgaguucaaguucacccuguacaagaacgaccugcuccuggugaaggacaccgagacgaaggagcagcagcuguuccgguuccucagccgcaccaugccaaagcagaagcacuacguggagcuaaagcccuacgacaagcagaaguucgagggcggagaggcccugaucaagguccucgggaacguggccaacuccggccagugcaagaagggacugggcaagagcaacaucuccaucuacaaggugcggaccgacguccuggggaaccaacacaucauuaagaacgagggggacaaacccaagcucgacuucaagcgccccgccgccaccaagaaggcgggccaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10376 - RNA, 4413 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggaauccacggcgucccggccgcgacccaguucgagggcuucaccaaccuguaccaggugagcaagacgcuccgguucgagcugaucccccaggggaagacccugaaacacauccaggagcagggcuucaucgaggaggacaaggcccgcaacgaccacuacaaggaacucaaacccaucaucgaccggaucuauaagaccuacgccgaccagugcuugcagcuggugcagcucgacugggagaaucuguccgccgccaucgacagcuaccgcaaggagaagaccgaggagacccguaacgcgcuuaucgaggagcaggccaccuaccgcaacgcuauucaugacuacuucaucgggcggaccgauaaccucaccgacgccauaaacaagcgccacgcugaaaucuacaagggccucuucaaggccgagcuauucaacggcaagguacuaaagcaguuagggacggugaccaccaccgagcacgagaaugcccuacuccgguccuucgacaaauucacgaccuacuucucaggcuucuacgaaaaccgcaagaacguguucagcgcagaggacaucagcaccgcaaucccccaccggaucguccaggacaauuucccgaaguuuaaggagaacugccauaucuucacccgucugaucacggcggugccgucccugcgggaacacuucgaaaacgugaagaaggccaucggaauuuuugucagcaccuccaucgaggagguguucaguuuccccuucuacaaccaguugcugacccagacccagaucgaccuguacaaccagcucuugggcgggaucucucgcgaggccggcacggagaagauaaagggcuuaaaugaggugcucaaccuggccauacagaagaacgacgagacagcccacaucauagcgagccugccccaccgguucaucccguuauucaaacagauccugucugaccguaacacccuuagcuucauccucgaggaguucaagagugacgaagaggucauccagucguucugcaaauacaagacccuucugcggaacgagaaugugcucgagacggccgaggcccuuuucaacgaacugaacuccaucgaccucacccacaucuucaucagccacaagaaacucgagaccaucagcagcgcccugugcgaccacugggacacccuccgcaacgcccuguacgagcggcgcaucagugagcugacgggcaagaucaccaaguccgcgaaggagaaggugcagcggagccucaagcaugaagacaucaaccugcaggagaucaucuccgccgccggcaaggagcugagugaggccuucaagcaaaagaccucagaaauccuaucccacgcucaugcggcccuggaccagccguugcccaccacgcucaagaagcaagaagagaaggagauccugaaaucccaguuagacagccugcucgggcuguaccaccuccucgacugguucgcagucgacgaauccaacgagguggaccccgaguuuagcgcccgccugaccggcauuaaacuggagauggagccgucccucagcuucuacaacaaggcgcgcaacuacgccaccaagaagcccuacuccguggagaaguucaagcugaacuuccagaugcccacgcuggccagcggcugggauguaaacaaggagaagaacaauggggccauacucuucgugaagaacggccuguacuaccuggggaucaugccuaagcaaaagggccgguacaaggccuuauccuucgagcccacggagaagaccagcgaaggguucgacaagauguacuacgacuacuuccccgacgcggccaaaaugauccccaagugcuccacacagcugaaagcagugaccgcccacuuccagacccacacgaccccgauucuguugaguaacaacuucaucgagccgcuggagaucaccaaagagaucuacgaucugaacaaccccgagaaggagcccaaaaaguuccagaccgccuaugcgaaaaagacgggagaccagaaaggcuaccgcgaggcccugugcaaguggaucgacuucacccgggauuuccuauccaaguacaccaagaccacgagcaucgaccugaguucacuccggccaagcucccaguacaaagaucugggggaguacuacgccgagcugaauccgcuccuguaucacaucucauuccaacggaucgccgagaaagagaucauggacgccguagagacgggcaagcucuaccucuuccagaucuacaacaaggacuucgcgaagggacaccacggcaagccuaaccugcacacauuguacuggaccggccucuucucccccgagaaccucgccaagacgagcaucaagcugaacgggcaggccgagcuguucuacaggcccaagagccggaugaagcgcauggcccacaggcugggugagaagaugcugaacaagaagcuaaaggaccagaagaccccgauccccgacacccuguaccaagagcuguaugacuacgugaaccaucgcuuaagccacgaccucuccgacgaggcgcgugccuuacuccccaacgugaucaccaaggaggucagccaugagaucaucaaggaccgcagauucacguccgacaaguucuucuuccacgugccgaucacacugaacuaccaggccgcuaacagccccuccaaguucaaccagcgcgucaacgccuaccuaaaggagcaccccgagacgcccaucauugggauagaccggggcgagcgcaaccugaucuauaucaccgugaucgacagcacggggaagauccuggagcaacgaucccugaacaccauccagcaguucgacuaccagaagaaacucgacaaccgcgaaaaagagcggguggcggcacgccaggccuggagcgucgugggcaccaucaaggaccugaagcagggguaccugagccaggugauccacgagaucgucgaccucaugauucacuaccaggccgucgugguccuggagaacuuaaacuucggcuucaaaucgaaacgcaccggcaucgccgagaaagcgguguaccagcaguucgagaagaugcucauugacaaguuaaacugccuggugcuaaaagauuacccggccgagaaggucggaggcgugcugaaccccuaccaguugacggaccaguucaccagcuucgccaagaugggcacccagucuggcuuccucuucuacgugcccgcccccuacaccagcaagaucgacccgcugacgggguucguagaccccuucguuuggaagaccaucaagaaccaugagagucggaagcacuuccuugagggguuugacuuccuccacuaugaugugaagacuggcgauuucauccugcacuucaagaugaaccgcaaccugagcuuccagcgggggcuccccgguuucaugcccgccugggacaucgucuucgagaagaaugagacccaguucgacgcgaaggggacgcccuucaucgccggcaagcgcauagucccugugaucgagaaccaccgguucaccggccgcuaccgggaucuguaccccgcaaacgagcugaucgcccuccuggaggagaaggggaucgucuuucgagacggcuccaacauccugcccaaguuguuagagaaugacgacagccacgcaaucgacaccaugguggcccugauucgguccgugcuccagaugcgcaacagcaacgcggccaccggggaggacuacaucaacuccccgguccgggaccugaacggcgugugcuuugauagccgcuuccagaaccccgaguggcccauggacgccgacgcgaacggggccuaccauaucgcccugaagggacaacucuugcugaaccaccucaaggagucuaaggaccucaagcugcaaaacgguaucagcaaccaggacuggcucgccuauauacaagagcugcggaacaagcgccccgccgcgacuaaaaaggcugggcaggccaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10377 - RNA, 4392 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10378 - RNA, 4596 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcuccaaaaaaaaaacgaaaaguuggaauccacggggugccagccgcugacaaaaaauauagcauuggccuagacaucgggacaaacucggucgguugggcaguuaucaccgaugaguauaaagugcccucuaaaaaauucaaaguccuaggaaauacagaucgacauucaauuaaaaagaaccuaauaggagcccuuuuauuugacaguggugaaacagcugaagcuacaaggcucaaacgaacagcucgaaggcgauacacgagacguaaaaaccgcauuuguuacuuacaagagauauucagcaaugaaauggcaaaaguagaugacuccuuuuuccauagacuagaagagucauuucucguggaagaagauaaaaaacacgaaagacauccaauauuuggcaauauagucgaugaaguugccuaucacgaaaaauaccccaccaucuaucaccuaaggaaaaaauuaguagacucaacagauaaagcagacuuaagauuaaucuaucuugcacuagcucacaugauuaaauucagaggacacuuucuaauugaaggagauuuaaacccugacaauagugauguagauaaauuauuuauacaacuaguacaaacauacaaucaacuguuugaagaaaauccaauaaaugccagcggcguagaugcaaaagcaaucuuaagcgcuagacucuccaaaucgagaaggcuagaaaaccucauagcacaacucccaggggagaaaaagaauggauuauucgguaaccucaucgcacuaaguuuaggucuuaccccaaauuucaaaagcaauuucgacuuagcagaagacgccaaacuacaguuaucaaaagauacauaugaugaugaccuagauaacuuacuagcccaaaucggagaucaauacgcugaucuauuucuugcagccaaaaaucucuccgaugccauucuauuaagugacauacuacgugucaauacagaaauaacaaaagcuccauuaucagcaagcaugauaaaaagauaugacgaacaccaccaagaccuaacucuguuaaaagcacuuguucgacaacaacuaccagaaaaauauaaagaaauuuuuuuugaccaaucgaaaaauggauaugccggcuauauagauggaggagcaucccaagaagaauucuauaaauuuauaaaaccaauauuggaaaaaauggauggcacagaagaacuacucguuaaacuaaacagagaagauuuacuacgaaaacaaagaaccuuugacaauggaaguauaccacaccagauccaccuaggcgaacuacacgcaauccuacgcagacaagaggauuucuacccauuccuaaaagauaaccgugaaaaaauagagaaaauauuaacauuuagaauacccuauuacguuggaccacuagcccgaggaaauagucguuuugcguggaugaccagaaagagcgaagaaacaauaacaccauggaauuucgaagaaguuguggauaaaggagcauccgcacagagcuuuaucgaacgaaugacaaauuuugacaaaaacuuaccaaacgaaaaagucuuaccaaagcacucacuauuauacgaauacuuuaccguuuacaacgaguuaacaaaagucaaauacgucacagaaggcaugagaaaaccugccuuucucuccggagaacaaaaaaaagcaauagucgaccuccuauucaaaaccaaucgaaaaguaacuguuaaacaacuaaaagaagacuacuuuaaaaaaauagaauguuuugauuccguagaaauaucuggcguugaagacagauuuaacgcaucacuaggaacuuaccacgauuuauuaaaaauuauaaaggacaaagauuuuuuagacaacgaagagaaugaggacauacuugaagauauaguacucacucucacacuauuugaggaccgcgaaaugauagaagaacgacuaaagaccuaugcccauuuauucgacgauaagguuaugaaacaacugaaacgccgaagguacacgggcuggggacgucuuagucgaaaauuaauaaauggaauacgugacaaacaaucaggaaaaacaauauuagauuuccuaaaaucagacggcuucgcuaauagaaauuuuaugcaauugauacacgaugacaguuuaacuuuuaaagaagauauacaaaaagcucagguaucaggucaaggagauucucuacaugaacauauagcaaacuuagccggaaguccagcaauaaaaaaagguauccuacaaacgguaaaagucguggacgaacucguaaaaguaaugggacgucacaaaccagaaaacauagugauugaaauggccagagaaaaccaaacuacucaaaaaggucaaaagaauagcagagaaaggaugaaacgcauugaggaaggaauaaaagaguugggaucacaaauauuaaaagaacaucccguagaaaauacucaauuacaaaaugaaaaauuguacuuauauuaucuccaaaacggcagagauauguauguagaucaagaauuagacauaaauagacuuagugauuaugacguagaccauaucguuccccaaaguuuccucaaagaugauagcauagauaacaaaguuuugacgagaucggauaaaaauagggggaaaucugauaauguuccaagugaagaagugguuaaaaaaaugaagaauuacuggcgucaacugcuaaacgccaagcuuauuacacaacggaaguuugacaacuuaacaaaagcagagcgaggcgguuuaagugaguuagauaaagcagguuuuauuaaaagacaauugguagaaaccagacaaauuacuaaacacguagcgcaaauccuagacaguagaaugaauacaaaguacgacgaaaacgacaaacuaauacgcgaaguuaaaguaauaaccuuaaaaaguaaacuuguaucagauuucagaaaagauuuccaauuuuacaaaguuagggaaauaaauaacuaccaucacgcacaugaugcauaccuaaacgcgguuguaggcacagcauuaauaaaaaaauaucccaaauuagaaagcgaauuugucuauggagauuacaaagucuaugacguaagaaaaaugaucgcaaagucagagcaagagauaggaaaggccacugcaaaauauuucuuuuauucaaacauaaugaacuuuuuuaagacagagauaacgcuugcuaacggcgaaaucagaaagcgaccacuaaucgaaacaaacggagagacgggggaaauaguuugggacaaagguagagacuuugcaacaguacgaaaaguuuugucuaugccucaagucaacauagucaaaaaaacagaaguacaaacaggaggauuuuccaaggagucaauuuuaccaaaaagaaauucagauaaauuaauugccagaaaaaaagacugggacccaaaaaaauauggcggauuugauucuccuaccguagcuuacucaguuuuaguaguggccaaaguggaaaaaggaaaaagcaaaaaacuaaaaucaguuaaagaauuacuaggcauuacuauaauggaaagaagcaguuucgaaaaaaacccaauugacuuucucgaagcuaaaggauacaaagaaguaaaaaaagaccuaaucauaaaacuacccaaauauucucuuuuugaauuagaaaacggaagaaagagaauguuggcgagugcaggagaauuacaaaaggguaaugaauuagcccucccaucaaaauacguaaacuuucuauacuuagcaucucacuaugaaaaauuaaaaggaucaccagaagauaaugaacaaaaacagcuauuuguagaacaacauaaacauuaucucgaugaaauaaucgaacagauaagugaauucucaaaaagagucaucuuagcugaugcaaacuuagacaagguccugucugcauauaauaaacacagagauaaaccgauucgcgagcaagcugaaaacauaauucauuuauuuacacuuacuaauuuaggagcgccugcggcuuuuaaauacuucgauacuacaaucgauagaaaaagauacacaagcacuaaagaaguccucgacgcaacauuaauucaucaaucuauuaccggacuauaugaaacaagaaucgauuuaagccaacuuggaggagacaaaagaccugcugcgacaaaaaaagcagggcaagccaaaaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10379 - RNA, 5379 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcacccaaaaaaaaacggaaaguggguauacacggugugcccgcagcuaauuuuaaaaucuugcccauagcgauugaccuaggcgucaaaaauacgggcguauucuccgcauucuaccaaaaagggacaucauuagaacgccuagacaacaaaaacgguaaaguuuacgaacuuuccaaagacucuuacaccuuacucaugaacaaccgcacagcccgacgacaccaaaggagaggaauagaccguaaacaacuggucaagagauuauuuaaacuaauauggacagagcagcuaaaucuagaaugggacaaagauacacaacaagcaauaucuuucuuauuuaaccgaagaggauucucauuuaucacagauggauacaguccagaauacuuaaacaucguuccugaacagguaaaagccauauugauggacaucuuugaugauuacaauggggaagaugaccucgacagcuaucuaaaacuugccaccgaacaagaaagcaagaucucagaaaucuacaauaaauuaaugcaaaaaaucuuagaauuuaaauuaaugaaacucuguaccgacauuaaggaugauaaaguaucuacaaaaacccucaaagaaauuaccucuuaugaauuugaauuauuagcagauuaccuagccaacuacuccgaaucucuuaaaacucaaaaguuuucauacaccgauaaacaaggaaaucugaaagagcuaaguuacuaucaucaugacaaauauaacauccaagaauuccuuaaaagacaugcaacaauaaacgacagaauauuggauaccuuacuuaccgacgaucuagauauuuggaauuucaacuuugaaaaauucgacuucgacaaaaacgaagaaaaauuacaaaaucaagaagacaaagaccacauucaagcacaccuccaccauuucguauucgcagugaacaaaaucaaaagugaaauggccucaggagguagacaucggagucaauacuuccaagaaaucacaaacguccuagacgaaaacaaucaccaggaaggauacuuaaaaaacuucugugaaaauuuacacaauaaaaaauauagcaaucugucaguaaaaaaucuuguaaaucugauaggaaaccucucgaacuuggaacugaagccacuacgaaaguacuucaaugauaaaauucacgcgaaagcagaucauugggacgaacaaaaauucacugaaacauacugccauuggauucuuggugaauggagaguagguguuaaagaccaagacaaaaaagacggcgccaaguacucauacaaagaucuaugcaacgaacuaaaacaaaaaguaacaaaagcggggcuagucgauuuucuccuagaauuagauccuugucgaacuauuccucccuaccucgacaacaauaauagaaaacccccaaaaugucaaucucuaauacuaaaccccaaauuucuagacaaucaauacccaaacuggcaacaauacuuacaagaacucaaaaaacuacaaucaauccagaacuaucuugauagcuuugaaacugaccuaaagguauuaaaaucuucaaaagaucaaccauauuuuguagaauauaaaaguucuaaucaacaaaucgcuagugggcagagagauuacaaagauuuggacgccagaauacuccaauuuauauucgauagaguuaaagcaucagacgaacuacuuuuaaacgaaauuuauuuucaggcgaagaagcuaaaacaaaaggcgagcagugaacuggaaaaacucgaaagcagcaaaaaauuagaugagguaauagcuaacucacaacuuucacaaauccuuaaaucacaacacacaaauggaauauuugaacaagggaccuuuuuacaucuaguauguaaauauuacaaacaaaggcaaagagcaagggauagccgauuauacaucaugccagaauacagauaugauaaaaaacugcacaaauauaacaacacaggacgcuuugacgacgacaaccaacucuuaacguauugcaaucauaaacccagacagaaacgcuaucaauuacuaaacgaccuagcuggaguccuacaaguuucccccaauuuccugaaagauaaaaucgguuccgacgaugaccuauuuauuagcaaauggcuuguagaacacauuagaggauucaaaaaagcaugugaagauucacuaaaaauacaaaaagacaauagaggacuauuaaaucacaaaauuaauaucgcaaggaauaccaaaggaaaaugugaaaaagaaaucuucaauuuaauuugcaaaauagaaggcucagaagauaaaaaaggaaacuacaaacauggacucgcauaugagcucggaguauuauuauucggugagcccaaugaagcaucuaaaccagaguuugaucgcaaaauaaaaaaguuuaacucgaucuacucguuugcccaaauucagcaaauugccuuugcagaacgaaagggaaaugccaacacuugcgcuguaugcucagccgacaacgcacaccguaugcaacaaauaaaaauaacugaaccaguagaagacaauaaagacaaaauaauucuaagcgcaaaagcacaaagacugccagccauaccuacaagaaucgucgacggagcagucaaaaaaauggcaacuauauuagcuaaaaauauaguagacgauaacuggcaaaacauaaaacagguguuaagcgcgaaacaucaauuacacauucccaucauuacugaguccaacgccuucgaauucgaaccagcccuugcagacguuaaaggcaaaaguuuaaaagaccgaagaaaaaaagcauuagaaaggauaagucccgaaaacaucuucaaagacaaaaauaaccguauuaaagaauucgccaaaggaauaucugccuacagcggugcaaaccuaacagacggugauuucgacggagccaaagaagagcuagaucauauuauaccccgaucccauaaaaaauacggaacuuugaaugacgaagcaaaccuaauaugcguaacacgaggagacaacaaaaacaaagggaauagaauauuuugucuuagagauuuagccgauaauuauaaauuaaaacaauuugaaacuaccgaugacuuagagauagaaaaaaaaauagccgacacaauaugggacgcuaauaaaaaagacuucaaauucgggaauuaucgauccuucauuaaucuaacgccccaagaacaaaaggcauuccgacaugcauuauucuuagcagacgagaacccaauaaaacaggccguaauaagagcuauaaacaaccgaaaucgaacuuuuguuaauggaacacaacgcuauuuugcagaaguacuggcaaauaauaucuaucuuagagccaaaaaagaaaaccuaaauacugacaaaauuucuuuugacuauuuuggaauacccaccauuggaaauggcaggggaauagcugaaauaagacaauuauaugaaaagguagacuccgacauccaagcauaugcaaaaggggauaaaccacaagcuuccuauucacaccuaauagacgcaauguuagcuuucugcauugcagcugacgagcauaggaaugacggaagcauaggacuugaaauagauaaaaacuacucccuauacccccucgauaaaaacacaggagaaguuuuuacaaaagauauauuuucacaaauaaagauaacggacaacgaguucucagauaaaaaacuaguaagaaagaaagcaaucgaaggauuuaacacacaccgccaaaugacucgcgacggcauuuaugcugaaaauuaccuucccauacuaauucacaaagaacuaaacgaaguacguaaaggauacacuuggaagaauucagaagaaauuaaaauuuuuaaaggaaaaaaguacgauauacaacaacucaacaauuuaguguauugccuaaaauuuguagauaaaccaauaucaauagacauccagaucucaacacuagaagaauuacguaacauauugacgaccaauaacaucgcagcuacagcagaauauuacuauaucaacuugaaaacccagaaguuacaugaauacuacauagaaaacuauaauacagcucuaggcuacaaaaaauauucaaaagagauggaauuccuuagaucacuugcauaucgaagcgaacgaguaaagaucaaaucgaucgaugacgucaaacaagucuuggauaaagauagcaacuucauaauaggaaaaauaacccucccuuuuaaaaaagaauggcaacggcuguauagagaauggcaaaacacaaccauuaaagaugacuaugaauuccuaaaauccuuuuuuaacguaaaauccauaacuaagcuucacaaaaaaguaagaaaagacuuuagcuuaccaauauccacaaacgaaggcaaauuucuaguaaagcgcaaaacaugggauaauaacuuuaucuaucaaauauuaaaugauagcgauagucgcgcggacggcacaaaacccuucaucccugccuucgacauaucgaaaaaugaaauaguugaagcaauaaucgacucauucaccaguaaaaacauauuuuggcuuccuaagaacaucgaauuacaaaaaguggacaauaaaaauauauuugcaauugacaccucaaagugguuugaaguagagaccccaagcgaccuccgugacauaggcauagcaacaauccaauauaaaauagacaauaacucaagaccaaaagucagaguuaaacuagacuauguaauugaugaugacaguaaaauaaacuacuucaugaaucacucauuacuaaaaagcagauauccagauaaaguacuugaaauauuaaaacaaagcacuauaauagaguucgaaucaucuggauucaacaaaacaauaaaagaaaugcuugguaugaaauuggcaggcauauacaacgaaacaaguaacaauaaaagaccugcagcaacaaaaaaggccggacaagcaaaaaaaaagaagugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10380 - RNA, 3651 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccaaaaaagaaaagaaaaguugguauucauggaguaccagcagcaaaaaggaacuauauauuaggcuuagacauaggaauaaccucaguaggauaugggauaauagacuaugaaaccagagauguaaucgaugccgguguacgccuuuucaaggaagcaaacguggaaaacaaugaaggcagaagaucaaaaagaggagcaagaagguuaaaacgacgcagaagacauagaauacaacgagucaagaaacuucuguucgacuauaaccuacuaacugaccacucagagcuaucaggcauaaacccguaugaagcacgaguaaagggcuuaagccaaaaguuaucagaagaagaauucuccgcugccuuacugcauuuagcaaaaagaaggggaguucauaacguaaaugaagucgaagaagacacggguaacgaacuuaguaccaaagagcaaauaagucgaaacuccaaagcacuagaagaaaaauauguagcagaacugcagcuagaacguuuaaaaaaagacggagaaguacgaggaucuauaaaucgauuuaaaacguccgauuacguaaaagaagcaaaacaauuguuaaagguacaaaaagcuuaccaccaacuagaucaaucauuuaucgauaccuauauagauuuacuagaaacucgacguaccuauuacgaaggaccaggugaaggcucacccuuuggcuggaaagauauuaaagaaugguaugaaaugcuuaugggacacugcaccuauuucccugaggaauuaagguccguaaaauacgcauacaaugcugaccuauacaacgcauuaaacgaccuaaauaaccuaguaauuaccagagaugaaaacgaaaaacuagaauacuacgaaaaauuccaaaucaucgaaaauguguuuaaacaaaaaaaaaaaccaacucuaaagcaaauugcaaaagaaauacucguaaaugaggaagauaucaaaggauacagaguuacaucaacagggaaaccugaauucacaaaccuaaaaguauaccacgauauaaaggauauaacagccagaaaagaaauuauagagaacgcggaauuacuagaucaaauugcaaaaauccugaccauauaccaaaguucagaagacauccaagaagaacuaacuaaccuaaacagcgaauuaacccaagaagagauagagcaaauaucuaauuuaaaaggcuacacaggaacacacaacuuaucauuaaaagcaauuaauuugauccuagacgaacuauggcacacaaacgauaaccagaucgccauuuuuaauagguuaaaacuaguaccgaaaaaaguggauuuaucacaacaaaaagaaauccccacaacuuuaguagacgauuuuauccuaucaccaguaguaaagagaucauuuauucaaucaauuaaaguaauaaacgcaauaauuaaaaaauacggcuuacccaacgacaucauaauagaacuugcgcgagaaaaaaacucaaaagacgcacaaaaaaugauaaaugaaaugcagaaaagaaauagacaaacaaaugaacgcauugaggaaaucauaaggacaaccggaaaagaaaacgcaaaauacuugauagagaagauaaaacuucacgacaugcaagaaggaaaauguuuauacucucucgaagccaucccauuagaagaccuacuaaauaauccauuuaauuacgaagucgaucauauaauaccccgaucuguaagcuucgacaacaguuuuaacaacaaaguacuuguaaagcaagaagaaaacucaaaaaaagggaauagaacucccuuccaguacuuaucaagcucagauucaaaaaucucauaugagacauucaaaaaacauauccucaaccuagcaaaagggaaaggucgcauaaguaaaaccaagaaagaauacuuauuagaagaaagagauauaaauagauuuucgguacaaaaagacuuuauuaauaggaaucuaguagacacaagauaugcaacaagagggcuaaugaauuuacuaagaucauacuuccgaguaaauaaucucgauguaaaagucaaaucaauuaauggaggauucacaucauuccugcgaagaaaauggaaauucaaaaaagaaagaaacaaaggauauaaacaucacgcggaagacgcccuuauaauagcaaacgcagauuucaucuucaaagaauggaaaaaacuagacaaagcuaaaaaaguuauggaaaaucagauguucgaagaaaaacaagcugaaucaaugccagagauugaaacagaacaagaauauaaagaaaucuucaucacaccccaucaaaucaagcacauaaaagauuucaaagacuacaaauauucacacagaguagauaaaaaacccaauagagaacucauaaacgauacauuauauucaacaagaaaagacgacaaaggaaauacacuaauaguaaacaaccuuaauggacuuuacgauaaagacaacgauaaacuaaaaaaacuaauaaacaaauccccugaaaaguuauuaauguaucaucacgacccccaaacauaccaaaaacucaaacuaauaauggaacaauauggagaugaaaaaaacccacuauauaaauauuacgaagaaacuggaaacuacuuaacaaaauauaguaaaaaggauaacggaccagucauaaaaaaaauaaaauauuauggaaauaaacucaaugcacaucuagauauuacagacgacuauccaaacucgagaaauaaaguagucaaauuaucacuaaaaccauaccgauuugacguuuauuuagauaacgggguauauaaauucguaaccguaaagaaucuagaugucauaaaaaaagaaaauuauuacgaagugaacucaaaaugcuacgaagaagccaagaaacuaaaaaaaauaucaaaccaagccgaauucauagcaaguuucuauaacaacgaccugaucaaaauaaacggagaacuauauagaguaauaggcguaaacaacgaccuuuuaaacagaauagaaguaaauaugauagauaucacguacagagaauaccuugaaaacaugaacgauaaaagacccccaagaauaauaaagacuaucgcuagcaaaacgcaaagcaucaaaaaauacucaacagauaucuuaggaaaccucuacgaagucaagucuaaaaaacauccacagauaaucaaaaaaggaaagcgcccagcugccacaaaaaaagcuggacaagccaagaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10381 - RNA, 4719 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcacccaaaaagaaaagaaaagucggcauacauggagugccagcagcccuauuuaauaaaugcaucauaauaucaauuaacuuagacuucagcaauaaagaaaaaugcaugacaaaaccuuacaguauaggauuggacaucggaacaaauucaguaggaugggcgguaauaacagacaauuauaaagugccgagcaagaaaaugaaaguucuuggcaacacaagcaagaaauacaucaagaaaaaccuacuaggagucuugcuuuuugauucaggcaucacagcagaaggucgaagacuaaaaagaacagcgagacgaagauacacccgacgcagaaauagaaucuuauaccuacaagaaaucuucagcacugaaauggcaaccuuagacgacgcauucuuucaacgacuugacgauagcuuccuaguaccagaugauaaaagagauuccaaauauccaaucuucggcaacuuaguagaagaaaaaguauaccacgacgaguuccccacaauuuaucacuuacgaaaauaucuagcagauagcaccaagaaagcagaccugagacucgucuaccuagcucuggcgcauaugauaaaauauagaggccauuuccuaauagaaggagaauuuaauagcaaaaacaacgacauacagaaaaauuuccaagauuucuuagacacauauaacgcaaucuuugaaagugauuuaagccuagaaaauagcaaacaauuagaagaaauagugaaagacaaaauaagcaaacuagagaagaaagacagaauauugaaacuauuccccggugagaaaaacucuggaaucuuuagcgaguucuuaaaauuaauaguagggaaccaagcagauuuuaggaaauguuuuaaccuugacgaaaaagcuaguuuacauuuuucaaaagaaucauacgaugaagaucuagaaacccuauuaggauauauuggagaugauuacucagacguauuccugaaagcaaagaaauuauaugacgcaauacuacucaguggauuccuuacaguuacagauaaugaaaccgaagcaccccuaucaagcgcaaugauaaaaagguauaaugaacacaaagaagaccuggcacuacuuaaagaauauauacgaaacaucucauuaaaaacuuacaaugaaguuuuuaaagaugauacuaaaaauggcuaugcuggguauauagacggaaaaacaaaucaagaagacuuuuaugucuaucucaaaaaccuacuagcagaauuugaaggugcagauuacuuuuuagagaaaauagauagagaagacuuucuaagaaaacaaagaaccuuugacaacggaucgaucccauaucaaauacaucuccaagaaaugagagccauauuagacaaacaagcaaaauucuauccguuccuagccaaaaauaaagaacguauagaaaagauacuaacuuuuagaauaccuuacuacguaggaccauuagcccgaggaaacucagacuucgcuuggagcauucgaaaaaggaacgagaaaauuacuccauggaacuucgaagacgucauugauaaagaaucguccgcugaagcauucauaaacagaaugacaucuuucgacuuauauuuaccagaagaaaaaguucuccccaaacauucacucuuauacgaaacauuuaacguauacaacgaacuaacaaaaguacgcuucauagcagaauccaugagggauuaucaauuccuagacagcaaacaaaagaaagauauuguaagacuauauuuuaaagauaaacguaaaguaacagauaaagacauaauagaauaccuccaugcuaucuauggguacgauggaauagaauugaaaggaaucgaaaaacaauucaacucaucauuaucaacauaucaugaucuacuaaacauaauaaaugacaaagaauuucuagaugauucuucaaacgaagcaauaauagaagaaaucauacacacauuaaccauuuuugaagacagagaaaugauaaaacaacgccuaucuaaauuugaaaacauauucgacaaaucgguacucaagaaacuaagcagaagacacuauacaggauggggaaaauuaagcgcaaaacuaaucaacggcauucgugaugaaaaaucaggcaauacuauauuagacuaccuuauagaugacggcauaucaaacagaaauuucaugcaauugauacacgaugaugcccucagcuucaaaaagaaaauccaaaaagcucaaauuauaggagaugaagacaaaggaaauauuaaagaaguuguaaaaagucuuccgggaaguccugccauaaagaaaggcauacuacaaucaauuaaaauaguugaugaauuaguuaaaguaaugggaggacgcaaaccagaaucaauaguuguggaaauggcacgagaaaaccaauauacuaaccaagguaaaucaaacagucaacaaagacuaaaacgccuagagaaaagccucaaagaauuaggaucaaaaauauuaaaagaaaacaucccagccaaacuuaguaaaauagacaacaaugcguuacagaacgacagacuauacuuauacuaccuucaaaauggaaaagacauguacacaggagaugaccuagauauagacagauuaucaaauuacgacauagaccauauuauuccacaggcuuucuuaaaagauaacuccauagauaauaaaguauuaguaagcucagcuagcaauagaggaaagagugacgauuucccaucccuagaagucguuaagaaaagaaaaacuuuuugguaccaauuguuaaaaaguaaacucauaagccaaagaaaauuugauaaccucacaaaggcagaaagaggaggacuuuuacccgaagauaaagcugguuuuauacaaagacagcuaguugaaacacgccaaauaacaaaacacguagcgagacuccuggaugaaaaauuuaauaauaagaaagacgaaaacaaccgggcugucaggacuguaaaaaucaucacccuaaaaucaaccuuaguuagucaguuucggaaagauuucgaacuguauaaaguaagagaaauaaacgauuuccaucaugcacacgaugcguauuuaaaugcugugauagcaucagcauuacucaagaaauauccaaaacuagaaccggaauuuguauauggagauuaccccaaauacaacaguuuucgcgaaagaaaaucagcaacagaaaaaguauacuuuuacucuaacauuaugaacauuuuuaagaaaucuauaagccuggcagauggaagaguaauagaaagacccuuaauagaagugaacgaagaaacaggagaaagcguauggaacaaagaaagugacuuagcaacagucagaagagugcuaaguuacccacaaguaaacguaguuaagaaagucgaagaacaaaaucacggacuggacagagggaaaccuaaaggcuuauuuaacgccaaucuuuccucaaaaccuaaaccaaauuccaaugaaaaccuagucggugcuaaagaauaccuagacccuaagaaauacgguggguacgcaggaauaucaaauagcuucgcuguuuuagugaaaggaacaauagaaaaaggagccaaaaagaaaauaacaaacgugcuugaguuccaaggaauaaguauacuagauagaauaaacuaccgaaaagauaaacugaacuucuugcuagagaaaggauacaaagacaucgaacucaucauagaauuacccaaauauuccuuguuugaacuaucagaugggaguagaagaaugcuagcaucgauacuaagcacaaacaauaaaaggggcgaaauacacaaagguaaucaaaucuuccucucucagaaauucgucaaacuauuauaucacgcuaaaagaaucucaaauacaauuaaugaaaaccauaggaaauacguagaaaaccacaagaaagaguucgaagaauuguuuuacuauauauuagaguucaacgaaaacuauguaggcgcuaagaaaaacgggaaacuacuaaauucagcauuccaaaguuggcaaaaccauaguauugacgaacuauguucguccuuuaucggccccacgggaucagaacguaaaggccuauucgaacuaacaucuagggguuccgcugcagacuucgaguucuuaggcguuaaaauaccgagauaucgagacuacacccccaguucccugcuuaaagaugcaacacuaauacaucaaucaguuacaggacuauacgaaacuagaauagauuuagcaaaauuaggagagggcaaaagaccagcagccacuaaaaaggcuggacaggccaagaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10382 - RNA, 3795 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcgccaaaaaaaaaaagaaaggugggaauacacgggguaccagcagcaugguaugcuuccuuaaugucagcucaccacuuaagaguaggaauagacguaggaacacauaguguaggauuggcaacacuuaggguagacgaucauggaacuccaauugaacuacuaagcgcauugucacauauucaugacucaggaguugguaaagaggguaagaaagaccacgacaccagaaaaaaauuaucaggaauagcacggagagcgagaaggcuucuacaucacagacgaacccaauuacagcagcuagacgaaguacuucgggacuuaggcuuucccaucccaacgccaggugaauucuuagacuugaacgagcaaacagauccauaucgaguuuggcgaguuagagcaaggcuuguggaagaaaaauuacccgaggaauuaagaggucccgcuauaaguauggcaguaaggcauauagcucgacaucgaggcuggaggaacccuuauucaaagguagaaagccuacucagucccgcagaagaaucaccauuuaugaaagcacucagagaaagaauauuggcaacaacaggugaaguacuugacgacggcauaacccccggucaagcgauggcacaaguagcauuaacucauaauauaaguaugcguggcccggaaggaauuuuaggaaaacuacaucaaucugacaacgcaaaugaaauacgaaaaauaugcgcuagacaaggcguaucaccugauguauguaaacaacuacuucgagccguguucaaagccgauucaccaagaggaagcgcuguuucacggguagcgccagauccauuaccaggacaaggcagcuuuagacgggcuccaaaaugcgauccagaauuucaaagauucaggauuauaucaauaguagcaaaucugcgaauaucggaaacaaaaggagaaaaccgaccguugacggcggaugaaagacgucacguaguaaccuuucuuaccgaagauucacaagcagaccuaacuuggguagauguagcagaaaaauuagggguucaccgucgugauuugaggggcacggccguacauacugacgacggagaaagauccgcagcuagaccgccuauagaugcaaccgacagaauaaugagacaaacaaaaauuaguagcuuaaaaacauggugggaagaagcagacagugaacaaagaggagcuaugauccgcuauuuauaugaagauccaacggacucagaaugugccgaaauuauagcagaauuaccagaagaagaucaagcaaaacucgacagcuuacauuuaccagcaggacgggcagcauauucaagagaaucacuuacugcauuaagcgaucacauguuagcuacaacagaugauuuacaugaggccaggaaaagauuauucggaguugaugauagcugggcccccccggcagaagcuauaaaugcccccguaggaaauccaucgguugauagaacacuuaaaauaguagguagauaccucagugcaguagaaucgauguggggaacaccagaaguaauucauguagaacauguaagagauggcuucacaagcgaaagaauggcagaugaaagagauaaagcaaauagacgacgauauaaugauaaucaagaagcaaugaaaaagauccagagagacuauggaaaagaaggauacauaagccgcggggacauaguacguuuagaugcacucgaauuacaagggugugcaugccuauacugcggaaccaccauuggcuaucacacaugccaacuugaucauauaguaccacaagcagguccaggaucaaauaauagaaggggaaauuuaguagcaguuugugaaagauguaauagaucaaagucuaacaccccuuuugcgguaugggcacagaaauguggcauuccacauguaggagucaaagaagcaauagguagaguacgagguuggcgaaaacaaacgccaaauacaaguagugaagauuuaaccagacuuaagaaagaaguuauagcaagacuaaggaggacacaagaagauccagaaaucgaugaaaggucaauggaaaguguagcauggauggcuaaugaauuacaucaccgaauagcagcagcauacccugaaaccacaguaaugguuuauagaggauccauaaccgcagcggcaagaaaagcugcaggaauagacagucgaauaaaucugauaggcgaaaaaggaagaaaagacagaaucgacaggcgucaccaugcaguagaugcaucaguuguagcucuaauggaagcuucaguagcaaaaacgcuggcagaacgaucaucuuuacgaggugaacagcgacuaacaggaaaagaacagacuuggaaacaauauacagggucuaccguaggcgcccgcgaacauuucgaaauguggagaggacauauguuacaccuaacagaauuauucaaugaacgucuagcagaagauaaaguauauguaacacagaauauaagauuacgacugagcgauggcaaugcucacacuguuaauccguccaaauuaguaagucauagacucggcgauggacuaacaguacaacaaauagauagagccuguacuccagcccuauggugugccuuaacaagagaaaaagauuuugacgaaaagaauggucuaccggcucgugaagauagggcaauaagaguucacggacaugaaauaaaaucgagugauuauauacaaguuuuuucuaaacguaaaaaaacugacagcgauagagacgaaacaccauuuggagcuauagcgguaagaggcggauuuguugaaauaggaccuucaauacaucacgcaagaauauacaggguagagggcaagaaacccguguacgcuaugcuuagaguauuuacucaugaccuuuuaagccaacgucauggggaucuguuuagugccguuaucccaccacaauccauauccaugaggugcgcagaaccaaaauuaagaaaagcaauaacaacuggcaaugcaacauaucuaggauggguagugguaggagaugaauuagaaauaaauguugauucguuuacaaaauaugcaauaggacgguuuuuagaagacuucccuaauacuacacgauggcgcauauguggauaugauaccaacagcaaacuuacuuugaaaccgaucguguuagcggcagaaggcuuagagaauccuucaagcgcuguuaacgaaauuguugaauuaaaaggauggagagucgcuauaaacguuuuaacaaaaguucauccaacaguaguaagaagagaugcuuugggucgaccaagauacucgucaaggucuaaccuaccaacuucauggaccauagagaaaagaccagcagcgacgaaaaaagccggccaagcaaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10383 - RNA, 4656 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcuccaaagaagaaaaggaaaguaggcauacacggaguaccagcugcaaccaaaccauauaguaucggccuagauauuggaaccaacaguguuggaugggcuguaacgacagauaacuauaaaguaccuucaaaaaaaaugaagguacuugguaauacaucaaagaaguauauaaaaaaaaaccuacuuggggucuuguuauuugacucuggcauaacagcagaaggaagaagacuaaagagaacagcccggcggagauacacuagaagaagaaauagaauccuauacuuacaagaaauauucucaaccgagauggcuacccuagacgaugcauuuuuucaacgauuagacgauaguuucuuaguaccagaugauaaacgcgacaguaaguauccaauauuuggaaacuuaguagaagaaaaagcauaccacgaugaauuuccaacgauauaccaucuaagaaaauauuuagcggacucuacaaaaaaagcagaucuacgauuaguauacuuagcacuagcacauaugaucaaauacagaggucacuuuuuaauagaaggagaauuuaacagcaagaacaaugacauucagaaaaacuuucaagauuucuuagauaccuauaacgcgauauucgaauccgauuuaagucuagaaaauucaaaacaacuagaagaaauaguaaaggacaaaaucaguaaauuagaaaaaaaagacaggauauuaaaacuauuuccuggugagaaaaauucaggcauauucagcgaauuccugaaauuaauugucggaaaccaggcggauuuucgaaagugcuucaaccuugacgaaaaagcaucauuacauuuuucaaaagaaaguuaugacgaagauuuggaaacgcuacuaggcuauauaggagacgacuacucagacgucuucuugaaagccaaaaaauuauaugaugcaauccuacuuucaggguuucucacaguaacugauaacgaaaccgaagcgcccuugagcucugcuaugauaaagcgauauaaugaacacaaagaagauuuagcccuacuaaaagaauauauaagaaauaucaguuugaaaaccuauaacgagguuuuuaaagaugauacuaaaaacggauaugcagguuacauagauggaaagacaaaucaggaagacuucuacguuuaccucaaaaaauuacuagcagaauuugaaggugccgacuauuuuuuggaaaaaauugauagagaagacuucuuacgcaaacagagaacguucgauaacggaaguauuccauaucaaauacaccuacaagaaaugcgggcuauacuggauaaacaagccaaauuuuauccauuccuugcaaaaaauaaagaacguauagaaaaaauacuaacuuuuagaaucccauauuacguaggaccauuagcuagaggaaauucagacuucgccuggucaauucgaaaaagaaaugagaaaauaacuccauggaauuuugaagacgucauagacaaagaaagcucagccgaagcguuuauaaauagaaugacauccuuugaccuguauuuaccagaagaaaagguacuaccaaaacacucucuacuauacgaaacguuuaacgucuacaaugaguuaacaaaaguacgcuucaucgcggaaaguaugcgggacuaccaauuccucgacagcaaacaaaaaaaagacauaguaagacuauacuuuaaggacaaacguaaaguuacugacaaagauauaauagaauauuuacaugcaauauauggauaugacggaauagaauuaaaaggaauagaaaaacaauucaauucuagccuaucaacguaccacgaucuucugaacauaauaaaugacaaagaguuccuagacgacagcuccaaugaggcaaucauagaagaaaucauccauacccuaaccauuuuugaagaucgugaaaugaucaaacaaagacugucgaaguuugaaaacauuuuugacaaaagcguauuaaaaaaacucaguagacgacauuacacaggaugggguaaacuaagugcuaaauuaauaaauggaauaagggaugaaaaguccgguaauacaauacucgacuaccuaauagaugaugggauaaguaaucgaaauuuuaugcaacuaauccaugacgacgcacuaagcuuuaaaaagaaaauacaaaaagcccaaauaauaggagaugaagacaaaggaaacauaaaagaaguaguaaagagcuuaccaggaaguccagcuauaaagaaagguauccuccagucuauaaaaauaguagaugaacucguuaaaguaaugggcggacggaaaccagagagcaucguuguggaaauggccagagaaaaucaauauacaaaucaaggaaaaaguaauucacaacaaaggcuaaaacgacuagaaaaaucacucaaagaacuugguagcaagauauuaaaagaaaacaucccagcaaaauuauccaaaaucgacaauaaugcacuacaaaaugacagacucuaucuuuauuaccuacaaaaugggaaggauauguauacuggcgacgaucucgacauagacaggcucucaaacuaugacaucgaucauauuauaccgcaagccuuccuaaaagauaauuccauagauaacaaaguucuaguaagcagugcuagcaacagagggaaaucagacgacgucccuucacuggaagucgucaaaaaacgaaagacauucugguaccaguuauuaaaaucaaaacuuaucucacaaagaaaauucgacaacuugacaaaagcggaacgcggaggccuauccccugaagacaaagcgggauuuauucaacgacaauugguugagacucgacaaauuacuaaacauguggcacgacuccucgaugaaaaauuuaacaacaaaaaagaugaaaacaaccgagcaguaagaacaguaaagaucauaacauuaaaaaguacacuuguaucacaauucagaaaggacuucgaacuuuauaaaguucgagaaauaaaugacuuccaccacgcacacgacgccuacuugaaugcaguagucgccagcgcauuacucaaaaaauauccuaaacucgaaccagaauucguuuacggagauuauccaaaauacaacucauuuagagaacggaagagcgcuacugaaaaaguauacuuuuauucaaacauaaugaacauauuuaaaaaaucgauaucauuagcugaugguagagucaucgaacgaccauuaauagaaguaaaugaagaaacuggugaauccguauggaacaaagaaucagaccuggcaacaguuagaagaguucuaucauauccucaaguaaacguuguaaaaaaaguagaagagcaaaaccacggccuagaucgaggaaaaccaaaaggccuauucaacgcuaacuugucauccaaaccaaaaccuaacucaaaugaaaacuuaguaggagcaaaagaauacuuagacccuaaaaaauacggcggcuacgcggggaucaguaacucguucacgguauuagucaaaggaaccaucgaaaaaggggccaagaaaaagauuacaaaugugcuagaauuccaaggaauauccaucuuagauagaauaaauuauagaaaagauaaauuaaacuuccuuuuagaaaaaggguauaaagacauagaacuaaucaucgaacuaccaaaauacucuuuauuugaacuaucagacgguucacguagaaugcuagcgaguauucucagcacaaauaacaaaagaggcgaaauucauaagggaaaucaaauuuuuuugucccaaaaauucguuaaacuucuauaccaugcgaaacgaauaucaaacacaaucaacgagaaucacagaaaauauguugaaaaccacaagaaagaauucgaagaacuguucuauuauauauuagaauucaacgaaaacuacgucggcgcaaaaaagaauggaaagcuauugaacagcgcauuccagagcuggcaaaaccacaguauugacgaacuauguucaucauucauuggcccaacaggaucugaacgaaaaggccuauucgagcuaacuagccggggcucugcagcagauuucgaauuucuaggaguaaaaauacccagauaucgagauuacacccccaguucacuauuaaaggacgcaacucuaauacaucagucaguaaccggacuuuacgaaacgagaauagaucuugcuaagcuuggcgaagguaaacgcccagcagcaacuaaaaaagcgggacaagcgaaaaagaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10384 - RNA, 3738 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccgaaaaagaaacgaaaagucggcauucauggaguaccugcagcagcagcauuuaaaccaaacucaauuaacuauauucuaggacucgauaucgggauagcaucaguagguugggcuaugguagagauugacgaagaagaaaacccgaucagacuaaucgauuuaggagucaggguauuugaaagagcagaaguaccaaaaacaggggacucccuugccauggcacgcagauuagcucgaaguguaagaagauuaacacgcagacgagcacaccgacucuugagaacacgccgacuucuaaaaagagagggaguacuacaggcagcuaauuucgaugaaaauggacuuaucaaaaguuuaccuaauacaccuuggcaauugagggcugcagcccuggauagaaaacuaacuccacucgaauggucugcaguauuguuacaucuaauaaaacacagagguuacuuaagucagcgaaagaaugaaggcgaaacugcagauaaagaauuaggugcacuauuaaaaggaguagcaggaaacgcacacgccuuacagacaggagauuuuagaacuccggcugaauuagccuuaaauaaauuugaaaaagaaagcggacauauucgaaaucaacggagugauuauucacacacuuucagcagaaaagaccugcaagcugaauuaauauuacuauuugaaaaacaaaaagaauuuggaaauccacauguaagcggaggguuaaaagaagggauugaaacuuuauuaaugacacaaagaccagccuugagcggugaugccguucagaaaauguuaggacauuguacuuucgaaccagcugaaccaaaagcagccaaaaacacauacacugccgaaagauuuauaugguuaacuaaauuaaauaauuugagaauauuagaacaagggucugagcgaccuuuaacagacaccgaacgugccacauuaauggaugaaccauacagaaaaucaaaacuaaccuaugcacaagcaagaaaacuauuaggcuuagaagauacugccuuuuucaaaggauugagguauggcaaagacaaugcugaagcaaguacauuaauggaaaugaaagcauaucaugcaauuaguagggccuuagaaaaagaggguuuaaaagacaagaaaagcccacuuaaucuuagcccagaauuacaagacgaaauuggaacggcauuuaguuuauuuaaaacagaugaggauauaaccgguagacuaaaagaucguauucaaccagaaauuuuggaggcauuacucaaacacaucuccuucgauaaauuugugcaaauaagucuaaaagcauuaagaagaauagugccccuaauggagcaaggaaaaagauaugacgaagcaugugcagaaauauauggagaccacuacggaaagaaaaauacugaagagaaaauauauuuaccuccgauaccggcugacgaaauaaggaauccuguaguguuacgagcguuaagucaagcaagaaaagucauuaacgguguugucagaagauauggaaguccagccaggauacacauagaaacagcaagagaagucgggaaauccuuuaaagauagaaaagaaaucgagaaaagacaagaagaaaaccgaaaagaccgcgaaaaagcagcugcaaaauucagagaauauuuuccaaacuuuguaggagaacccaaaagcaaagacauacuaaaacuuagauuauaugaacaacaacauggcaaauguuuauauagcggcaaggaaauaaaucuagguagacuuaaugaaaaaggauauguugagauagaucacgcacuaccauuuucacggacaugggaugauaguuucaacaauaaaguccuagucuugggaagcgaaaaccaaaacaaagguaaccaaacaccauaugaauauuuuaauggaaaagacaauagcagagaguggcaagaguucaaagcgagaguggaaacuucaagauucccacgaucaaagaaacaacgcauauuacuacagaaauucgaugaagauggauuuaaagaaagaaaucugaaugacacaagguacguaaacagauuucuaugucaguuuguugccgacaggaugcgacuuacgggaaaagguaagaaacggguauuugcaucaaacggacaaauaaccaaccucuuacgaggguucuggggacuacggaaaguaagagcggaaaacgauagacaucaugcuuuagaugcagucgucguagcgugcaguacgguggcaaugcagcagaaaauaaccagguucguccgauacaaagaaaugaaugcauucgacggaaaaaccauagacaaagaaacaggagaaguucuacaucagaaaacacacuucccucaaccaugggaguucuucgcucaagaagucaugaucagaguauuugguaaaccugauggaaaaccagaauuugaagaagcagauacuuuagaaaaauuaaggacacuacuagcagaaaaacuaaguuccagaccagaagcuguacacgaauaugucacuccguuauucgucucaagggcaccaaaccggaaaaugaguggucaagggcacauggaaaccguaaaaucagcuaaaagacucgaugaaggaguaagcguacuuagaguuccauuaacacaacuaaaacuaaaagauuuagagaaaaugguaaaucgagaaagagaaccaaaacucuacgaagcacuaaaagcacgacuagaagcccacaaagaugacccagcgaaggcuuuugcggaacccuucuauaaauaugauaaagcuggcaaucguacucaacaaguaaaagcagugaggguggaacaagugcaaaagacuggaguuuggguaaggaaucauaauggcauagcggacaaugccacgauggucagaguagauguuuuugaaaaaggugauaaauacuauuuagucccaauauauucuuggcaaguggcaaaaggaauauuaccagauagagcgguaguccaaggaaaagaugaagaagauuggcaacuaauugacgauaguuuuaacuuuaaguucucauugcacccaaaugacuuaguagaaguaauuacaaagaaagccagaauguuuggcuauuuugcaucaugucauagaggaaccggaaauauaaauauaagaauacaugaccuugaccauaaaauagguaaaaauggaauacuagaaggaauaggagucaaaacugcacuuagcuuucaaaaguaucagauugaugaacuaggaaaagaaaucaggccaugccgacuaaagaaaagaccaccgguaagaaaacgaccggcagcaacaaagaaagcgggacaagcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10385 - RNA, 4494 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccaaaaaaaaaaagaaaaguuggcauacaugggguuccagcagcaaaaaaaccauauacaauuggacuagacauagguacaaauucggugggaugggccgucuuaacagaucaauacgaccuaguaaagaggaaaaugaaaauagccggagacagugaaaaaaaacaaauaaagaaaaauuucuggggaguaaggcuauucgacgaaggacaaacagcagccgaucgaagaauggccaggacugccaggagacguaucgaaagaaggaggaauagaaucagcuaccuucaaggaauauucgcagaagaaaugagcaaaacggacgcgaacuuuuuuuguaggcucagcgauucguuuuacguagacaaugaaaaaagaaacaguagacauccauuuuucgcaaccaucgaagaagaaguagaauaccauaaaaacuacccaacaauuuaucaccuucgcgaagagcuaguaaacaguagugaaaaagcugacuuaagacuuguauaucuggcccuagcacauauaauaaaguauagaggcaacuuuuuaauagaaggagcuuuagacacacagaauacaaguguagacgggaucuauaaacaauuuauucaaacauacaaucagguauucgcauccggaauagaagauggcagccuuaaaaaacuagaggacaauaaagacguagcuaaaauacuggucgaaaaaguuacaagaaaagaaaaacucgaaagaauauuaaaacuuuauccaggagaaaaaagugcuggaauguuugcacaauuuauaucauuaauaguaggaagcaaaggcaauuuucaaaaaccguucgaucuuauugaaaaaagugacauagaaugugccaaagauagcuacgaagaggaccuagagagucuccuugcacuaauuggugaugaauacgcagagcuauucguagcagcaaaaaaugcauauagcgcaguagucuugucaucaaucauaaccgucgccgaaaccgaaacuaacgcgaaauuaagugcauccaugauugaacgauucgacacacaugaggaagaucuuggugaacuaaaggccuucaucaaacuacauuuaccaaaacacuaugaagaaauauuuucaaauacagaaaaacacggauaugccggauacauagaugguaaaacaaaacaagcagacuucuacaaauacaugaaaaugacguuagaaaauauagaaggugcagauuacuuuaucgcuaaaauagaaaaagaaaauuuccugcguaaacaaagaacuuuugauaacggagcgauaccacaucaacuacacuuagaagaauuggaagcuauucuacaccaacaagcaaaauacuauccauuuuuaaaagaaaacuaugacaaaaucaaaucauuaguaaccuucagaauuccuuacuuuguuggaccccuugcaaacggacaaagcgaauuugcaugguuaacaagaaaagcggacggggaaauaaggccauggaacaucgaagaaaaaguagacuuuggaaagucagcaguagacuuuauagaaaaaaugacaaauaaggacacuuaucuaccaaaagagaaugucuuaccaaaacauagucuaugcuaucaaaaauaucugguauacaacgaacucacuaaaguaagauacaucaacgaccaagggaaaacaucauacuuuucgggacaagagaaagaacaaauauucaaugaccucuuuaaacaaaaaagaaaaguuaaaaaaaaagaucuagaacuauuccugaggaauaugucacacguugaaaguccaacaauagagggcuuagaagacuccuuuaauucaucguacucaacauaucaugaucuccuaaaaguugguauaaaacaggaaauacucgacaaccccgucaauacagaaauguuggaaaauaucgucaaaauacuaacaguauucgaagacaaaagaaugauaaaagaacaauuacaacaguuuagugauguauuagacggaguuguauugaaaaaauuagaaagacgccacuacacaggauggggaagauugagugcaaaacuucuaaugggcauuagagauaaacagagucauuugacgauuuuagauuacuuaaugaacgacgacggacuaaacaggaauuuaaugcaacuaauaaacgacaguaaccuuucauuuaagucaauuauagagaaagaacaagugacaaccgcagacaaagauauacaaagcauuguagcggaucuagcagguagcccugcgaucaagaaaggaaucuuacaaucauugaagauaguagaugaacuggucagugugaugggauacccaccacaaacuauaguuguagaaauggcucgcgagaaucaaacuaccgguaagggaaagaauaacagcagacccagauacaagagucuagaaaaagcuauaaaagaauuuggaucacaaauauuaaaagaacauccaacagacaaucaagaacuaagaaacaauagauuauauuuauacuauuuacaaaacggcaaagacauguauacuggccaagacuuagauauacacaacuuaucaaauuaugauauagaccacauuguaccgcaauccuucauaaccgauaauucuaucgacaauuuaguuuugacaagcagugcaggaaaccgcgaaaaaggagacgauguuccuccccuugaaaucguuagaaaaagaaaaguauuuugggagaaacuuuaucaaggaaacuuaaugucaaaaaggaaauucgacuaucuuaccaaagcagaaagaggaggucucacagaagcugauaaagcacgguucauacaucgacaauuagucgagacaagacaaauaaccaaaaacguagcuaauaucuugcaccaaagauucaauuaugaaaaagacgaccacggaaacacuaugaaacaaguaagaauaguaacuuuaaaauccgcacugguuucacaauucaggaaacaauuucagcuauauaaaguaagagauguaaaugacuaucaucacgcucacgaugcauauuuaaaugguguagucgcaaauacguuauuaaaaguguacccacaacuggaaccugaauuugucuauggugacuaccaucaauucgacugguucaaagcgaacaaagccacggcaaaaaaacaauucuacacaaacaucaugcuuuucuucgcacagaaagauagaauaauagaugaaaauggagaaauauuaugggauaagaaauacuuagacacagucaagaaaguaaugaguuacaggcaaaugaauauaguuaaaaaaacagaaauacaaaaaggcgaauuuaguaaagcuaccauaaaaccuaaagguaauucaucaaaacuuauaccccguaaaacgaauugggauccaaugaaauacggaggacuagacucaccaaauauggccuacgcuguagucaucgaauaugcaaaaggaaaaaauaaacucguuuucgaaaaaaaaauaauaagggugacaauaauggaaagaaaagcuuucgaaaaggaugaaaaagcauuccuagaagaacagggauauagacaacccaaaguucuagcaaaauugccaaaauacacacuauacgaaugcgaagaaggacguaggcggauguuagcaucagcaaacgaagcacaaaaaggaaaucaacaaguucuacccaaccacuuaguaacucuucuucaucaugcagccaacugcgaagucagugacggaaaaucccuggacuacaucgaaucaaacagagaaauguuugcugaacuccuagcccacguaagugaauuugcuaagagauacacucuagcggaagcaaauuugaauaagauaaaucaacuauuugaacaaaacaaagaaggcgauauuaaggcuauugcacaaucauucguagaucuuauggcauuuaacgcgaugggugcuccggcaagcuucaaguucuucgaaacgacaauagaaaggaagagauacaacaaccuaaaagaauuacuuaauuccacaauaaucuaucaaaguauaacgggccuauaugaaagcagaaaacgucuugaugauaaacgaccugcggcaacuaaaaaagcggggcaagcuaagaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10386 - RNA, 4527 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcgccuaaaaagaaaaggaaggucggcauacauggaguaccugcagcaaaaaaacccuacaguauaggauuggauauaggaacaaauucuguaggaugggcaguaguaaccgacgacuacaagguaccagcaaaaaaaaugaaaguacucggaaauacagacaaaucacauauagagaagaacuugcuaggagcuuuguuguucgauagcggaaacacagcugaagacagaagguuaaaaaggacagcccgacgacgauacacuagaagacgaaaucgaauuuuauacuugcaagaaaucuucuccgaggaaaugggcaaaguagacgauaguuucuuccauaggcuugaagauucauuccuagugacugaagauaaacguggggaaaggcauccgauauucggaaaucuugaagaagaaguaaaauaccacgaaaacuuucccacuauauaucacuugaggcaauaucuggccgauaaucccgaaaaaguagaccugagacuaguauaucucgcacuagcacauauaauaaaauuuagaggccauuucuuaauagaagguaaguuugacacgcgaaacaaugauguacaaagauuauuccaagaauuuuuagccguauacgauaacacauuugaaaacaguagcuuacaagaacaaaacguccaaguagaagaaauacuuacagauaaaauaagcaaaucugcaaaaaaggaccggguucuaaaacuguuucccaacgaaaaaucuaacggaagguuugcagaauuucucaaauugaucguaggaaaccaagcagacuucaaaaaacacuuugaacuagaggaaaaagcaccacuacaguuuaguaaagauaccuaugaagaagaacuagaaguguuauuagcccaaaucggagacaauuacgcugaacuguuuuuaucagccaagaagcuauacgauagcauacuccuaucaggaauacuaacaguaacagauguaggcacaaaagcaccauugagugcauccaugauacaacgcuauaaugaacaucaaauggacuuagcucaauuaaaacaauucauaagacaaaaauuaucagacaaauacaacgaaguauucagcgauguaucaaaagauggauaugccggcuauauagacggaaaaaccaaucaagaagcguuuuacaaauaucuaaaaggauuacuaaauaaaauagaaggaucaggauacuuccuagacaaaauugaacgggaagacuucuugcggaaacagagaacauuugauaacggcucaauaccucaucaaauacacuugcaagagaugcgagcaauaauccgacgccaagcagaauucuauccauuuuuagcagauaaucaagaccggauagaaaaacuauuaacauucaggauuccauacuauguaggacccuuagcuagaggaaaaagcgauuucgcauggcuaaguagaaaaagcgcagauaaaaucaccccuuggaauuucgacgaaauagucgacaaagaaucaucagcagaagcguuuauuaauagaaugacuaacuacgacuuauaccucccgaaucaaaagguacuaccaaaacacucccuccucuacgaaaaauucacagucuauaacgaacuaacuaaaguaaaauauaaaacugaacaaggcaaaaccgcauucuucgaugcuaauaugaaacaagaaauauucgauggcguauucaaagucuaucgaaagguuaccaaggacaaauuaauggauuuccuagaaaaggaauucgacgaguuccgaauaguagaucucaccggauuagacaaagaaaacaaaguauuuaaugcaucauauggcacauaccaugaccucuguaagauucuagacaaagacuuucucgauaauucaaagaaugaaaaaauccuagaggacauaguacuaacacucacucucuucgaagacagagaaaugauaaggaaaagguuagaaaacuacagcgacuuacuaacuaaggagcaaguaaagaaacuagaacgaagacacuacacgggauggggacggcuaucagcagaauuaauucacggcaucagaaauaaagaaucucgcaaaacaauccuggacuauuuaauagacgauggcaauucuaauaggaauuuuaugcaacugauaaacgacgaugcacucucauuuaaagaagaaauugcuaaagcacagguaauaggugaaacagauaaccugaaucaaguaguaucagacauagcuggaucaccggcaauaaaaaaaggcauccuacaaucucuuaaaauaguagacgaauuaguaaaaauuaugggccaucaaccggaaaauauaguuguugaaauggcaagggaaaaucaauucacuaaccaaggacgaaggaacucacagcaacgacuuaaaggacugacugacuccauaaaagaguucgggagccaaauccuaaaagaacacccagucgaaaacagccaacuccaaaacgauagauuauucuuauacuaccugcaaaacggaagggacauguacacaggagaagaacuggauaucgacuauuuaagucaauaugacauugaucacauaaucccucaagcuuuuauuaaagauaacucaauagacaauagaguucugacuucguccaaagaaaacagagggaaaagcgaugacguaccaaguaaggacgucguccgaaaaaugaaaucauacuggagcaaacuauuaucagcaaaacuaauaacacaacggaaauuugacaaccuuacaaaagccgaacguggcggccucacggaugaugauaaagcgggauucauuaaaagacaacuuguagaaacacgacaaauaacaaagcacguugcaagaauacuugaugaaagauucaacacggaaacagacgagaauaacaagaaaauaaggcaagucaaaauaguaacacugaagaguaaccucgucucaaacuuuagaaaagaauucgaacucuauaagguacgagaaaucaaugacuaucaucaugcacaugaugcauaccuaaaugcuguaauaggaaaagccuuauugggaguauauccacaacuagaaccagaauucguauauggugacuauccacacuuccacggacauaaggagaauaaagcuacagcgaagaaauucuuuuauucaaauaucaugaauuucuucaaaaaagaugacguaagaaccgacaaaaauggcgaaauaauauggaaaaaagacgaacacauaucaaauaucaaaaaagucuuaucauauccacaaguaaauauugucaaaaaaguagaagaacaaaccggaggauuuaguaaagaauccauauuaccuaaagguaacucagacaaacuaauuccuagaaaaacaaagaaguuuuacugggacacgaagaaguauggcgguuucgacaguccaauaguagccuauucgauacucguaauagcagacauagaaaagggaaaaaguaaaaaguuaaaaacagucaaagcgcuagucggaguuacaauaauggaaaaaaugacauuugaacgagacccaguugcauucuuggaacgaaaaggauacagaaauguacaggaagaaaacauaaucaagcuuccaaaauacagccuauuuaaacuagaaaauggacggaaacgauuguuggccucagcaagagaauugcaaaaaggaaacgaaauuguacuaccaaaccacuuagggacacuuuuguaccacgcuaaaaauauacacaaagucgacgaaccaaaacaccuagacuacguagauaaacauaaagacgaauuuaaagaacuucuagacgucgucucuaauuucuccaaaaaauacacucucgcugaagggaaccuagagaaaauaaaagaauuauaugcacagaauaauggagaagacuuaaaagaacuagcaucuaguuucauaaaucuauuaacauuuacugcaauuggagcaccagcaacauucaaauucuucgacaaaaacauagacagaaagagauacacuucaacaacagaaauauuaaacgcaacauuaauccaccaaucaauaacugggcuauacgagacccgaauagaccuaaauaaguuagggggcgacaaaagaccugcagcgacuaaaaaagcgggacaagcgaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10387 - RNA, 3660 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcacccaaaaagaaaaggaaaguugguauccauggcgugccagcagcccaaaccacaaaucuaaguuacauacuaggccucgaccuaggaauagcaagcguagguugggcggucgucgaaauuaacgaaaacgaagacccuauuggacucauagauguaggagucagaaucuucgaacgcgcagaaguaccaaaaacaggggaaucacucgccuuaucaagaagacuagccagauccacacguagauuaauaagacguagagcacaccgacucuuacuggccaaaagauuucugaaaagagaaggcauauuaagcaccauagaucuagaaaaaggauuacccaaucaagcaugggaauuacgaguagccggacuagaaagacgcuuauccgcaaucgaauggggagcaguacuauuacacuuaauaaaacauagaggauauuuaagcaaacggaaaaacgaaagccaaaccaauaauaaagaacuaggagcguuauuaaguggaguagcucaaaaccaucaauuacuacagagugacgacuauagaacgccugccgaauuagcacucaagaaauucgcaaaagaagagggacauauuagaaaucaacgcggagcauauacacacacauuuaacagauuagacuuauuagcagaacuaaaucuacucuucgcccaacaacaucaauuugggaauccgcauugcaaagaacauauccaacaauacaugacagaauugcuuauguggcagaagcccgcuuuaucgggugaagcaauucuuaagauguuaggaaaaugcacccacgagaaaaaugaguucaaagccgcaaaacauacauauuccgcagaaagauucguauggcuaacaaaacuuaacaaucuuagaauacucgaagacggagcagaacgagcacuaaacgaagaagaaaggcaacuguuaauuaaccaccccuacgaaaaaucaaaacuaacauaugcccaaguucgaaaguuacucgguuuaucagaacaagcuauauuuaaacacuuaagauauucaaaggaaaacgcggaaucugcaacuuuuauggaauuaaaagccuggcaugcaauaagaaaggcuuuagaaaaccaaggcuuaaaagacacauggcaagacuuagcuaagaaaccagauuuacuggaugaaauaggaacugcuuuuucacuauacaaaacagacgaagauauacaacaguauuuaacaaacaaaguacccaacagcgugauaaaugcauuauuaguaucauuaaacuuugacaaauucauagaauuaagccuaaaaucacugcggaaaaucuuaccauuaauggaacaggguaaaagauaugaccaagccuguagagagauauauggacaccauuauggggaagcgaaucagaaaaccagccaacuauuaccagcgauuccugcacaagaaauaagaaacccagugguauuaagaacacuaagccaagcuagaaaagucauuaaugccauaauuagacaguauggaagcccugccagaguacacaucgagacuggacgagaacuaggcaaaaguuucaaagagagacgagagauacagaaacaacaagaggacaacagaacaaaacgcgaaucugcaguacaaaaauucaaagaacuauuuuccgacuucucauccgaaccaaaaaguaaagacauacuaaaauuccgauuauacgagcaacaacacggaaaaugucuauauagcggcaaagaaauaaacauacacagacuaaaugagaaaggauauguagaaauugaucaugcccuaccauucuccagaacuugggacgacucuuuuaauaauaaaguacugguauuagcgucagaaaaccaaaauaaaggaaaccagacaccauaugaguggcuacaagguaaaauaaauucagaaagauggaaaaauuucgucgcccuaguccuaggcucacaauguuccgccgcgaagaaacaacgcuuacucacucaaguuauagacgacaacaaauucauagauagaaaccuaaacgacacgagguacauagcccgauuucuaucaaacuacauacaagaaaacuuacuccucguagguaaaaauaagaaaaauguuuuuacaccaaauggccaaauaacagcacuacuacguucacgcuggggccuaauaaaagcaagagaaaauaacaauagacaucaugcccuagacgccauaguuguugcaugcgcaacgcccucuaugcaacagaaaauaacaagguucauaagauuuaaagaaguacauccguacaaaaucgagaauagauaugaaaugguagaccaagaauccggagaaauaauaagcccacacuuuccagaaccaugggccuacuucagacaagaagucaauauaagaguauuugacaaucacccugauaccguacuaaaagaaauguuaccagaucgaccgcaagcaaaccaucaauucguucaaccauuauuuguaagucgcgcaccuacuaggaaaaugaguggacaaggacacauggaaacaaucaaaagcgcuaaaagauuagccgaaggaauuaguguguuaagaauaccucuaacacaacuaaaacccaacuuacucgaaaauaugguaaacaaagaaagagaaccagcacuauaugcaggucuaaaagcaagguuggcagaauuuaaucaagauccugcaaaagcauucgcaacccccuucuacaaacaaggaggccaacagguuaaagcgauaagaguagaacaaguucagaaauccggagugcuaguuagagaaaacaacgguguggccgauaacgcguccauagucagaaccgacguauuuaucaaaaacaauaaauucuuucugguacccauauauacauggcaaguagcaaaaggaauccuaccaaacaaagcuauagucgcacauaaaaacgaagacgaaugggaagaaauggacgaaggcgccaaauuuaaauucagucuuuucccaaacgacuuaguugaacuaaaaacuaagaaagaauauuucuuuggauauuauauaggguuggauagagccacgggaaauauuagcuuaaaagaacacgacggggaaaucucuaaaggcaaagacggaguauacagaguaggagucaaauuagcauuaaguuucgaaaaauaucaaguagacgaauuagguaaaaacagacaaauauguagaccgcaacaacgacaaccaguucgaaagagaccagcagcaacaaagaaagcaggacaagcgaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10388 - RNA, 3738 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcgccaaagaagaaaaggaaaguuggcauccauggcgucccugcagcagcagcauuuaaaccaaaccccauuaacuacauacucggacuagauauuggcaucgcaucggucggaugggcuaugguagagauugaugaagaugaaaauccuauuugcuuaauagaccuaggaguaagaguauucgaaagggcagaagucccgaaaacuggagauagucucgcgauggcacgaagauuagcacgcucggucagaaggcuaacccgacgacgugcccaucguuugcuacgagcaagaagacuacuaaaaagggaaggcguacuacaagccgccgauuuugacgagaauggacugauaaagagcuuaccaaauacaccauggcaguuaagggcugcggcucuugaccgaaaacuuacaccauuagaguggagcgcuguacuuuuacaucuuauaaaacacagaggauaccuaucacaacggaaaaacgaaggugaaacagcagauaaagaauuaggagcccuauuaaaaggaguagcagacaaugcgcaugcacuacaaacaggcgacuucagaacuccugcagaauuagcauuaaauaaauuugaaaaagaaaguggacauauaaggaaccaaagaggagauuauagucauacguucaguagaaaagacuugcaagcagaauuaauccuccuauucgaaaaacaaaaagaguucggaaacccucauguaaguggcgguuuaaaagaaggcauagaaaccuuauugaugacacaacgcccagcucuaaguggagacgcuguacagaaaauguuaggccauugcacauuugaaccagcugaacccaaagccgccaaaaacacauauacagcagaaagauucaucugguuaaccaaauuaaauaauuuacgaauauuagaacaaggaagcgaaagaccauuaacagacacagaaagggcaacccucauggaugaaccauaucguaaaucgaaauuaacauaugcacaagcacgaaaacuguuaggauuagaagacacagccuuuuucaaaggccugcgauauggaaaagauaacgccgaagccagcacacuaauggaaaugaaggccuaccaugccauaucucgcgcacucgaaaaagaaggacugaaagacaagaaaucuccucucaaccuuucuccagaacuacaagaugaaaucgguaccgcauuuucacuauuuaaaacagaugaagacauaacgggcagacucaaagauagaauacagcccgaaaucuuagaagcauuacucaaacacauaaguuucgauaaauuuguccaaaucagcuuaaaagcacuacgucgaauuguaccacuaauggaacaaggcaaaagauaugacgaagcaugcgcagaaauauauggugaucauuauggcaagaaaaacacagaagagaaaaucuaccugccaccgauaccagccgaugaaauaagaaacccuguaguauuacgagcauuaagccaagcaagaaaaguuauaaacggaguagugcgacgcuacggaagucccgcacgcauucacauagaaacugcacgggaaguaggaaaaucuuuuaaagauagaaaagaaauagaaaaacgacaagaagaaaauagaaaagauagagaaaaagcagcagcaaaauuuagggaauacuuuccaaauuucguaggagaaccaaaaaguaaggacauauuaaaauuaagauuguaugaacaacagcacggaaaaugucuguauucaggaaaagaaauaaauuuaggaagauuaaaugaaaaaggauauguagaaauagaucaugcucucccauuuaguagaacuugggaugacucuuuuaacaacaaaguauuaguacuugguagugaaaaucaaaauaaagguaaccaaacuccauacgaauauuucaacggaaaagacaacucacgcgaauggcaggaauuuaaggcaagggucgaaacgucaagauucccaaggucaaagaaacagaggauacuauuacaaaaauuugacgaagacggauuuaaagaaaggaaccuuaacgauacaagauauguaaauagauucuuaugucaauuuguagcggacagaaugagauuaacugggaaaggcaagaaaaggguauucgcaaguaacgggcaaauuaccaaccuuuuaaggggcuucuggggacucagaaaaguacgagccgaaaacgacagacaccaugcauuagacgcggugguaguagcauguuccacaguggcaaugcaacagaaaauuacaagauuuguaagauacaaagaaaugaacgccuuugauggaaaaacgauagacaaagaaacgggagaaguacuacaucaaaagacacauuucccgcaaccuugggaguucuuugcgcaagaaguuaugauuagaguauucggaaaaccggaugggaaaccagaauuugaagaagcagauacacccgaaaaacuacgaacauuauuagcagaaaaacuaucaaguagaccggaagcagugcaugaauauguaacgccuuuauuuguuucacgagcaccuaauagaaaaaugucaggucaaggacacauggaaacaguuaaaucagcaaaacgacuagaugaaggcguuucuguacuaaggguuccacuuacacaauuaaaacuuaaagauuuagagaaaauggugaacagagaacgagaaccgaaguuauaugaagcauuaaaagcucgauuagaggcgcacaaggacgauccugcaaaagcauucgcagaaccauuuuauaaauacgauaaagcagggaauagaacacaacaaguaaaagcuguacgaguagaacaaguucaaaagacuggaguuuggguacguaaucauaauggcauagcugacaaugccacaaugguaagaguagaugucuuugaaaaaggagacaaauauuaucuaguaccaauauacucauggcaaguugcaaaagguauucuaccagacagagcaguuguucaaggaaaagaugaagaagauuggcaacuaaucgaugauagcuucaauuucaaauuuagcuugcauccaaacgaucucguagaaguaauaacaaagaaagcaagaauguuuggauauuuugccuccugucacagaggaaccgguaauaucaauauacgaauccacgaucuagaucauaaaauagguaagaacggaauacuagaggggauaggcguaaaaacagcuuuaaguuuucaaaaauaccaaauugacgaacuagggaaggaaauuagacccugcagauuaaagaaaagacccccuguaagaaaaagaccugccgcaacaaagaaagcaggacaagcuaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10389 - RNA, 3744 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccgaaaaagaaaagaaaaguaggcauacaugguguaccagcagcaaaauaucauguaggaauagauguugguacauuuucaguaggcuuagcagcuauugaaguagacgacgccgggaugccaauaaaaacguuaagccucguaucccauauacaugacaguggccuggacccagacgagauaaaaucugcgguaacacgacuagcaaguucaggaaucgcccgacgaacuagaaggcuuuauagacgaaaacgaagacguuuacaacaacucgauaaauucauacaacgucaaggauggccaguaauagaguuggaggauuauagcgacccacucuauccauggaaaguucgagcugaacuugcagcuucuuacaucgcagacgaaaaagaaagaggugaaaaauugucgguagcacuuagacacauagcaagacauagaggauggcguaacccauaugcaaaaguaaguagcuuauaucuaccagauggaccaucugaugccuuuaaagccauacgcgaggaaaucaaaagagcauccggacaacccguaccugaaacagcaacaguuggccaaaugguaacacuaugugaauuaggaacauuaaaacuaagaggagagggaggcgucuugagugcaagacuacaacaaagugauuacgcacgugaaauucaagaaauaugucguaugcaagaaauaggacaggaacuauacagaaaaauaauugacgucguauuugcagcagagucaccgaaaggaucugcaucuagucgaguagguaaagauccauuacaaccugguaaaaacagagcacucaaggcuucagaugcauuccagagauauagaauugcagcauuaauaggcaauuuacgaguccggguugauggagagaaaaggauauuauccguagaagagaaaaaucuaguauuugaucaccucgucaauuuaacaccgaagaaagaaccagaauggguaacuauagcagaaauauuagggauagauagaggucaacuaauugguacagcuacaaugacugacgauggggaaagagcaggagcacguccuccaacacaugauaccaauagaucuauaguaaauaguagaauagcaccauuagucgauugguggaaaacagcaagugcuuuagaacaacaugcuaugguuaaggcacuaucaaacgcagaagucgacgauuuugacucaccugaaggugcaaaaguacaagcauuuuucgccgaucuugacgacgauguacacgcaaaacuugauucacugcaccuaccaguagguagagcagcauauagcgaagacacucuagucagauuaacaagaagaaugcuaucagacgguguagaucuuuauacagccagauuacaagaauuugguaucgaaccuucauggaccccaccgacacccagaauuggagaaccaguaggaaauccggcaguagaucgaguauuaaaaaccguuaguagaugguuggaaagugcgacaaagacauggggugcuccagaaagagucauaaucgaacaugucagggaaggguucgugacggagaaaagggcuagagaaauggacggugauaugagacgucgagcugccagaaacgcaaaacuuuuucaagaaaugcaggaaaaauuaaacguacaagggaaaccuagucgagcagacuuauggcgguaccaaucgguacaaagacagaauugucaaugugcauauugcggaaguccaauaacauucucaaacucagaaauggaucacauaguaccaagagcaggucaaggaucuaccaauacgagagaaaaucuuguggcagugugccacagauguaaucaguccaaaggcaauacaccuuuugcaauaugggcuaaaaauacaucuauagaaggaguaucaguaaaagaagcuguagaacgcaccaggcauugggucacggacacaggcaugagaaguacggauuuuaaaaaguucacuaaagcagugguagaaagauuccaacgagcuacaauggaugaagaaauugaugcuagaucaauggaaucaguagcauggauggcaaacgaauuaaggagcagaguagcacaacauuucgcaucccacggcacuacggugaggguauauagaggcagcuuaacagcggaagcaaggcgagcaucugguauaaguggaaaacugaaauucuuugacggaguaggaaaaucacgacuagaucguagacaccacgcaauugaugcagcaguuauagcuuuuacaucggauuacgucgcggaaacuuuggccguacgcuccaacuuaaagcaaucacaagcacauaggcaagaagcaccacaauggagagaauuuacagguaaagacgcagaacacagggcagcauggagaguauggugucagaaaauggaaaaacuaagcgccuuauuaacagaagaucuaagagacgaucguguaguugucaugaguaaugucagacuacguuuaggaaacggaucagcacauaaagaaacaaucggaaaauuaucaaagguaaagcuaagcucacaauuaucaguuucugacauugacaaggcuucuucugaagcauuauggugugcgcuuacacgagaaccagguuuugaucccaaagaaggucuaccugcaaauccagaaagacauauuagaguaaacggaacacauguauaugcaggggauaauauaggccuauuuccaguaucugcaggaaguaucgcauuaagagggggauaugcugaacuaggaagcagcuuucaucacgcaagaguauacaaaauuacaaguggaaagaaaccagcuuuugcaaugcuucgaguuuauaccauugaccugcuaccauacagaaaccaagaccuauuuucgguagaauuaaaaccucaaacaaugaguaugagacaagcagaaaagaaacugagagacgcuuuagcaacugguaaugccgaguacuuaggauggcuaguuguugaugaugagcuaguaguugacacuagcaaaauugcaacugaccaagucaaagcgguugaagcagaauugggcacaauaaggcgauggagaguugacggguucuucucaccaagcaaauuaagauuacgaccuuuacaaaugucaaaagaaggaauaaagaaagaaucagccccagaacuuagcaaaauaauugaccguccuggguggcuaccagcagugaacaaacucuucucagacgguaauguaaccguuguacgaagagauucucuuggccgcguacgacuagaaaguaccgcacacuugccaguaacauggaaaguacagaaaagaccagcugcuacaaagaaagcaggacaagcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10390 - RNA, 3444 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccaaaaaaaaaaagaaaaguaggaauacacgguguucccgcagccgcaagaauacuagcauuugacauaggaaucagcagcauaggaugggccuuuucagaaaacgacgaauuaaaagacuguggaguaagaauauucacaaaaguagaaaacccaaaaaccggugaaucguuagcccuucccaggcgucuagccagaucagcaagaaaaaggcucgcacgccggaaagcacgacuuaaccaccucaaacaccuaauagccaacgaauuuaaacuaaauuacgaggauuaccaaucuuucgaugaaucauuagcaaaagcauauaaaggaucauuaauaucccccuaugaauuaagauucagggcacucaaugaacuacuuucuaaacaagacuuugcaagagucauacuccacauagcaaaaagacgaggauaugaugacauaaaaaauucugacgacaaagaaaaaggcgcaauacuaaaagcgauaaaacaaaaugaggaaaaacuagccaacuaccagucaguaggcgaauacuuauauaaagaauacuuccaaaaguucaaggaaaacaguaaagaauuuacaaauguacgaaacaaaaaagaaucguacgagagaugcauagcacagucauucuuaaaagaugaacuaaaacuaauauucaaaaaacaacgggaauuuggauucucuuuuuccaaaaaauucgaagaagaaguacuaagugucgcauuuuauaagcgagcucugaaagauuuuagccacuuagucggcaacuguuccuucuucacagacgaaaaaagagcgccgaaaaacucaccacuugcauucauguucgucgcauuaacucgaauaauaaaucuucuaaacaacuuaaaaaacacagaaggaauacuauacacaaaagaugaccugaacgcacuauuaaacgaaguauuaaaaaacggaacauuaacguauaaacaaacaaaaaaacuacuaggccuaagugacgacuaugaauucaagggugaaaaaggaacauacuucauugaauuuaaaaaauauaaagaauucauaaaagcucuaggagaacacaaccuaagucaggacgaucuaaacgaaauagcaaaagauauaacacuuaucaaagaugaaaucaaacucaaaaaagcacuagccaaauacgaucucaaccagaaucaaauagauucauugagcaaauuggaauucaaagaucaccuaaacauuucauucaaagcccucaaacuaguuacaccucuaaugcuagaagguaaaaaauacgacgaagcaugcaacgaacuuaaucuaaaaguagcaauuaacgaagacaaaaaagacuuucugcccgccuuuaacgaaaccuacuauaaagacgaaguaacaaauccuguaguauuacgagcaaucaaggaauacagaaaaguacucaacgcauuacuaaaaaaauauggaaaaguucauaaaaucaacauagaacucgcuagagaaguaggaaaaaaccauucccaaagagccaaaauugagaaagaacaaaacgaaaacuauaaagccaaaaaagacgcagaauuagaaugugaaaaacuaggacuuaaaauaaacagcaaaaacauauuaaaauuaagguuauucaaagaacaaaaggaauucugcgcauauucaggagaaaagauaaaaauuucugaccuucaagaugaaaaaauguuagaaauagaucacauauauccauauucuagaaguuucgaugacagcuauaugaauaaaguacuaguauucacaaaacaaaaccaagaaaaacuuaaucaaacuccauucgaagcuuucggaaaugacagcgccaaauggcaaaaaauagaagugcuagcaaaaaacuuaccaaccaaaaaacaaaaaagaauucuagacaaaaauuauaaagacaaagaacagaaaaacuucaaggacagaaaccugaaugauaccagauacaucgccagacuugugcuaaacuauaccaaagacuacuuagacuuccugccccuaucagacgaugaaaacaccaaguuaaaugacacccaaaaaggcucaaaagugcacguagaagcaaaaucaggaauguuaacuagugccuuaaggcauacauggggauucucagcaaaggauagaaacaaccaccuacaucacgcaauagacgcaguaaucaucgcauacgcgaauaauucaaucgucaaagcauuuagugacuucaaaaaagaacaagaaucuaauagcgcugaauuauaugccaaaaaaauaagcgaauuagacuacaaaaacaagaggaaauucuucgagccauuuucgggauucagacaaaaaguacuagacaaaaucgacgaaauuuuuguaagcaaacccgaacgaaagaaacccaguggggcauuacacgaagaaaccuucagaaaagaagaggaauuuuaucagaguuauggaggcaaagaaggaguccuaaaagcacuagaacuaggaaaaauacguaaaguaaacggaaaaauugucaaaaauggcgauauguucagaguagacauauuuaaacauaaaaaaacaaacaaauuuuaugccguaccuauauacaccauggauuucgcucuuaaaguacuaccuaauaaagcggucgcuagaucaaaaaaaggagaaaucaaggacuggauccuaauggacgaaaacuacgaauuuugcuucagucucuacaaagacucacuaauauugauacaaacaaaagauaugcaagaaccugaauucguguauuauaaugcuuuuacaucuucaacagugagcuuaauugucuccaaacaugacaacaaauucgaaacacuauccaaaaaccaaaaaauccuguucaaaaacgcaaaugaaaaagaaguaauugcaaaaucaauaggaauccaaaaucucaaaguuuucgaaaaauacauaguauccgcacuaggagaagucaccaaagcagaguuuagacaacgagaagauuucaaaaaaaagaggccagcagcaacaaaaaaagccggacaagcaaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10391 - RNA, 3855 nt, Artificial Sequence
  Cas9 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcuccuaaaaagaaaagaaaagucgguauacauggaguacccgcagcaucugaccuaguacugggacuugacauaggaauaggcagcguaggggucggcauacuaaacaaaguaaccggagaaauaauacauaaaaacaguagaauauuuccugcagcccaagcagaaaauaaccuagucaggcguacaaaucgccaaggacgaaggcucgccagaaggaagaaacacagaagaguaagacucaaccgauuauuugaagagucagggcugauaaccgacuucaccaaaauaucaauaaaccucaacccuuaucaauuaagaguaaaaggccucacagaugagcuaucaaacgaggaacuauucauagcacuuaaaaacaugguaaaacauagaggcauuucauacuuagaugacgccucagaugacggaaauucaucgguaggagauuaugcacaaauuguaaaagagaacuccaaacaacuugaaaccaaaaccccaggacaaauacaauuagaaagauaccagacauacggacaacucagaggagacuucacaguagaaaaagacggaaagaaacaccgacugauaaaugucuucccuacaagcgcuuacaggagugaagcucucagaauacuucaaacccaacaagaauuuaauccacaaaucaccgaugaauuuauuaauagauaccuugagaucuuaacgggaaaacguaaauauuaccacggaccuggaaacgaaaaaucgagaaccgauuauggaagauauaggacaaguggagaaacacuggauaacaucuucggaauacucauagguaaaugcacauucuauccagaugaauuuagagccgcaaaagccagcuauaccgcacaggaguucaauuuacuaaacgaucuaaacaaucuaaccgucccaacagaaacaaagaaacuaucaaaagaacagaaaaaccaaaucauaaauuacguuaaaaacgaaaaagcaaugggaccugcaaaacucuuuaaauacauagcaaaacuccuaagcugcgacguagccgacauaaaagguuaccgaaucgauaaaucgggaaaagcugaaauccacacauuugaagcauauagaaaaaugaaaacacuagaaacacuugacauagaacaaauggaucgggagacauuagacaaacucgccuaugucuuaacacuaaauacagaaagagaaggaauacaagaggcacuugagcacgaauuugcugacgggaguuucucucaaaaacaaguagaugagcuaguacaauucagaaaagcaaauucaagcauauucggaaaaggauggcacaacuuuucagucaaacucaugauggaacugauucccgaacuuuaugaaacaagugaggaacaaaugacgauauuaacaagacuagguaaacagaaaaccacuagcaguucaaauaaaaccaaauauaucgaugaaaaauuacuaacugaagaaaucuauaauccagucguagcaaaaucaguacgucaagcuauaaaaauaguaaaugcagcaaucaaagaauacggagauuuugauaacauaguaauagaaauggcaagagaaaccaacgaagaugaugaaaagaaagcuauacagaaaauccaaaaagccaauaaagacgaaaaagaugccgcuaugcuaaaagcugcuaaucaauauaauggaaaagcagaacugccacacucaguauuucaugggcacaaacaauuagcaacuaaaauaagacuauggcaccagcaaggcgaaagaugccuauauacaggaaaaacaauaucaauacaugaccuaauaaacaacaguaaccaauucgaaguagaucauauacuuccccuaucgauaacauuugacgauucacuagcuaacaaagugcucguuuacgcaacagcaaaccaagaaaaaggccaacgaaccccauaucaagcacucgauucaauggacgacgccuggucauuucgcgaacuuaaagcauuuguccgagaaucuaaaacacuuucaaacaaaaagaaagaauauuuauuaacagaagaagacaucucgaaauucgacguuaggaagaaauuuaucgaaagaaaccuagucgacacuagauacgcaagucgaguaguccuaaaugcauuacaggaacacuuccgggcucauaaaauugacacaaaagugucaguaguccgaggccaauucacaucacaacuacgccgacacuggggaauagagaaaacuagagacacauaucaccaccaugccgucgaugcacugaucauagccgcuaguucacaauuaaacuuauggaagaaacagaaaaauacucucguaaguuacagcgaagaucaacuacuagauaucgaaacaggagaauuaauuagugacgaugaauacaaagaaucaguauucaaagcacccuaucaacacuuuguagauacauuaaaaagcaaagaguucgaagauaguauccuauucucuuaucaaguagacuccaaauuuaacagaaaaaucucugacgcaaccauauacgccacacgacaagcaaaagucgguaaagacaaagcagaugaaacuuacguucuagggaaaauaaaagauauauacacacaagacggcuaugacgcuuucaugaaaauauacaagaaagauaaaucaaaauuucuuauguacagacaugacccucaaacauucgaaaaaguuauagaaccuaucuuagaaaacuacccaaacaaacaaauaaaugaaaaaggaaaagaagucccauguaauccauuucucaaauacaaagaagaacacggcuacauucguaaauacuccaagaaaggaaauggaccagaaauaaaaucucuuaaauauuacgacuccaaauuaggaaaucauauagauauaacccccaaagacucuaauaauaaaguaguucuacaaagcguaaguccauggcgugcagacgucuauuucaacaaaacaacaggcaaauaugaaauacucggccuaaaauaugcagacuuacaauuugaaaaaggaacagguaccuauaaaauaucgcaagaaaaauacaacgacauaaagaagaaagaaggaguugauagcgauagugaauuuaaauuuacacucuacaaaaaugauuuacuauuaguaaaagauacugaaaccaaagaacaacaauuauuuagauuccuauccagaacuaugcccaaacaaaaacauuauguagaacucaaaccuuacgauaaacaaaaauuugaagggggcgaggcacuaauaaaaguacugggaaacguagcaaacaguggccaauguaagaaagguuuaggaaaauccaauauaagcauauacaaaguuaggacagacguauuagguaaccaacauauaauuaaaaacgaaggcgauaaaccuaaacuggacuucaaaagaccagcagcaacaaagaaagccggucaagccaagaaaaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10392 - RNA, 4413 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcaccaaagaagaaacgaaaagugggaauacacggaguaccugcagccacacaauucgaaggcuucaccaaucucuaccaaguuucaaaaacucuccgauuugaacuaauaccacaaggaaaaacauugaaacacauacaagaacagggcuucauagaagaagauaaagcucgcaaugaucauuauaaagaacuaaaaccaauaauagauagaauauacaaaacauaugcagaccaaugucuacaacucguucaacuagauugggaaaaccucagcgcugcaauagacucauaccgaaaagagaaaaccgaagagacaagaaaugcacugauagaagaacaagcaacauacagaaaugcuauccaugauuauuucauaggaagaacugauaaucugaccgaugcuaucaacaaacgacaugcagaaauauauaaaggccucuucaaagcagaacuguuuaauggcaaaguauuaaaacaacuggggaccguaacaaccacggaacacgaaaaugcauuacucaggucauuugacaaauuuacaacauacuuuucagguuuuuacgaaaaccgcaaaaacguauuuucagcugaagauauuucuacagccauaccucauagaauaguacaagacaacuuucccaaauuuaaagagaauugccauauauucacuagacucaucacagcuguaccaucacuacgcgaacacuuugaaaacguuaagaaagccauuggaauuuuuguaucgacaucuauagaagaagucuucuccuucccuuuuuauaaucagcuacuaacacagacacagaucgauuuauacaaccaauuacuaggcgguauuagucgcgaagccgguacagagaaaauaaaaggucuaaaugaaguacucaaccuggcaauucagaaaaaugacgaaacagcccauauaauagcauccuuaccacacagauucauaccuuuauuuaaacaaauucuaucggauaggaauacucuaucauucauccuagaagaguucaaauccgacgaagaagugauacaaucauuuugcaaauauaaaacucuucucagaaaugaaaacguccuugaaacagcugaagcccuauucaaugaacuaaauucaauagaucuaacgcacauauucaucucacacaagaaacuagaaacuauaucauccgccuuaugugaucacugggauacccuucgaaaugcccuauaugaaagaaggaucagcgaacuuacggguaaaauaacaaaauccgccaaagaaaaagugcaacgaucuuuaaaacacgaagacaucaaucuacaagaaauaaucuccgcggcugguaaagaauuaagcgaggcuuuuaaacagaaaacauccgaaauccuaucccaugcacaugcugcccuagaccaaccauuaccaaccacccugaagaaacaagaagagaaagaaaucuuaaaaucccaauuagauucacuucucggucuauaucaucucuuggacugguucgcaguagacgaaaguaacgaaguagauccagaguucucagcacgucuaaccggaauuaaauuagaaauggaaccaucauuaucauuuuauaacaaagcaagaaauuaugcuaccaagaaaccauacucgguagagaaauucaaacuaaacuuucaaaugcccacacuagcaucaggcugggauguuaauaaagagaaaaauaacggugcaauacuauuuguuaaaaacggauuauacuaccuaggaaucaugccuaaacaaaaaggcagauauaaagcauuaucauucgaaccuacagagaaaaccucugaaggauuugacaaaauguauuaugacuacuucccagaugccgcaaaaaugauaccaaaauguucuacacaacucaaagcaguaacugcccauuuccaaacucauacaacuccgauauuauugucaaauaauuucauagaaccacuagaaauaacaaaagaaauauacgacuuaaauaauccugaaaaagaaccuaagaaauuucaaacagcauacgcaaagaaaacuggagaccaaaaaggauacagagaagcacuuuguaaauggauagacuucacucgcgacuuucuuuccaaauacaccaaaacaacuagcauugaccuauccucuuuaagaccaucuagccaauacaaagaccuaggcgaauacuacgcagaacucaauccucuauuauaucauaucucauuccaaagaaucgcagaaaaagaaauaauggacgcuguagaaacaggaaaacuauaucuauuucaaauauauaacaaagacuuugcaaaaggacaucauggaaaaccaaaucugcacacacuuuauuggacaggacuuuuuagcccagaaaauuuagcaaaaacaucaauaaagcuaaacggccaagcagaacucuucuauagaccuaaaucaagaaugaaaagaauggcacaccgucuaggagaaaagauguuaaauaagaaacuaaaagaccagaaaacacccauuccagacacauuauaucaagaauuauaugacuauguaaaccaccgccuaucacaugaccuaucagaugaagcuagagcacuguuaccaaauguaauaacaaaagaagucucacacgaaaucauaaaagaucgucguuucacauccgacaaauucuuuuuccaugucccaaucacacugaacuaccaagcagcaaauucaccuucaaaauuuaaucaaagagugaacgcauauuuaaaagaacaucccgaaacucccaucaucggaauugacagaggugaaagaaacuuaauauauauaaccguaauagacuccacuggcaaaauccuagaacaaaggucgcucaacacaauccaacaauuugacuaucagaagaaacuugauaaucgagagaaagaaagagucgcagcacgacaagccuggucuguaguagguacgauaaaagaucucaaacagggauaccuaucacaagucauacaugaaauagucgauuuaaugauccacuaucaagcagucgucguccuagaaaaccuaaauuucgguuucaaaucaaaacggacaggcauagccgaaaaagcaguauaucaacaauuugagaaaaugcuuauugacaaacuaaauugucucguuuuaaaagauuaccccgccgaaaaaguaggaggaguccuuaaucccuaucaacuaaccgaccaauuuacuagcuucgcuaaaaugggcacacaauccggauuccuguuuuacguaccugcaccauacacgucaaaaaucgauccccucacgggauucgucgacccauucgucuggaaaacuauuaaaaaccacgaaagccggaaacauuuccuggaaggauucgacuuucuucacuacgacguuaaaacgggugacuuuauccuccauuucaaaaugaaccgaaaucuaucauuccaaagaggccuuccaggcuuuaugccggcaugggauaucguguucgagaaaaacgaaacacaauuugacgcaaaagguacaccuuucauagcgggaaaacgaaucgucccaguaauagaaaaccacagauuuacaggcagguacagagacuuauaucccgcaaaugaacuuauugcccuauuagaagaaaaaggaaucguauucagagacggaucaaacauacuaccaaaacuauuagaaaacgacgacucccaugcaauugacacuauggucgcccuaauccgaucuguucuacaaaugagaaacucaaacgccgcaacaggcgaagacuauauaaacucaccaguaagagaucugaacggugugugcuucgauucuagauuccaaaauccugaauggccuauggaugcugaugcaaacggagccuaucauauagcacuuaaaggccaauuacuacuuaaccaucuuaaagaaucaaaagaucuaaaauuacagaacggaauaucuaaucaagauugguuagcuuacauacaggaacuaagaaacaaaagaccugcugccacuaagaaagccggacaggcuaaaaagaagaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10393 - RNA, 4392 nt, Artificial Sequence
  Cpf1 variant mRNA product
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggcgcccaaaaaaaaaagaaaagugggaauacaugguguuccagcagccuccauauaccaggaauuuguaaacaaauacucacuuucaaaaacacuacgauucgaauugaucccacaaggaaaaacacuagagaacauuaaagcacgugggcuaauacucgacgacgaaaaaagggccaaagacuacaaaaaagcuaaacagauaauagacaaauaucaccaauucuucauagaggaaauacuaagcucaguuuguaucucagaggaucugcuacaaaauuauucagacguauauuucaaauuaaaaaaaucggacgaugacaaucuacaaaaagacuuuaaaagcgcaaaagacacaauaaagaaacaaauaagugaauauauaaaagauucugaaaaauucaaaaaccuauucaaccaaaaucuaauagacgcaaaaaaaggacaggaaucugaccuaauccuauggcuaaaacaaagcaaagacaacggaaucgaauuauucaaagcaaauucugauauuacagauauagaugaagcgcuagagauaauaaaaagcuucaagggauggacuaccuacuuuaaggguuuccaugaaaaccgcaaaaauguauacuccagcaaugacauccccaccucaauaauuuaucgaaucguagacgauaaucuaccaaaauuccucgaaaacaaagcaaaauacgaaucauugaaagacaaagccccagaagccauaaacuaugaacaaauaaaaaaggauuuagcagaggaacuaaccuuugacauagauuacaagacuucagaaguuaaccagagggucuucucccuugacgaggucuuugaaaucgccaacuucaacaauuacuuaaaccaauccggaauaacaaaauuuaauacaauuauagguggcaaauuugugaauggagaaaacaccaaacgcaaaggcauaaaugaauacauuaaucuauacagccaacaaauaaaugauaaaacucucaaaaaauacaaaaugagcguacucuucaaacaaauccuaagcgauacagaaaguaaaaguuucguaauagacaagcuugaggaugauucggauguuguaaccacuaugcaaagcuucuaugagcaaauagcagcuuucaaaacaguggaagagaaaucaauaaaagaaacacuaucucuauuguucgaugaucuaaaagcucaaaaacuagaccuaucaaaaaucuacuucaaaaaugacaaaucacuaaccgaccuaucucaacaaguauucgaugacuacaguguaauaggaacagcaguacuagaauacauaacacaacagauugccccgaaaaaucuagacaacccuucaaagaaagaacaagaacuaauagcgaaaaagacagaaaaagcaaaauaccuuagccucgaaacaauaaaacuagcccucgaggaauuuaacaaacacagagauauagacaaacaaugcagauucgaagaaauauuagcaaacuuugcagcaauacccaugauuuucgacgaaauagcacaaaauaaggauaaccuagcacagauaucaaucaaauaccaaaaccagggaaaaaaagaccuccugcaagcaucagcagaagacgacguaaaagcgauaaaagaucugcuagaucaaacaaacaaccuauuacacaaauuaaaaauuuuccacauuagucaaagugaagacaaagcaaacauauuagauaaggaugaacacuucuaucuaguauucgaggaaugcuauuuugaacucgcaaacauaguaccauuauauaacaaaauccguaauuauaucacgcaaaaacccuauucagacgaaaaauuuaaauuaaacuuugaaaauucgacgcuugcuaacgggugggacaaaaacaaagaaccagacaauacggcaauacucuuuauaaaagaugauaaauauuacuuaggcguuaugaacaaaaaaaauaacaaaauauucgaugacaaagccauuaaagaaaacaaaggagaagguuacaaaaaaauuguguacaaacuauugccuggugcuaacaaaaugcuccccaaggucuucuuuucagccaagucuauaaaauucuacaacccauccgaagacauacuccgaauacgaaaucacucaacacauacaaaaaacggaagcccacaaaaaggauaugagaaguucgaauucaacauagaagacuguagaaaauucaucgacuuuuauaagcagucuauaaguaaacaccccgaauggaaagacuuuggauuuagauucucagacacccaacgauacaauucaauagaugaauucuaccgagaaguggaaaaccagggauacaaguuaaccuucgaaaacauaagcgaaucauacauagauucagucgucaaucaaggcaaacuauaccuauuccaaauauauaacaaagacuuuagcgcauauuccaaaggaagacccaaucuucauacauuauauuggaaagcauuauuugacgaaagaaaccuacaagauguaguuuauaaauuaaauggcgaagcagagcuauucuaucggaagcaaucaauucccaaaaaaauaacgcacccagccaaagaagccauagcaaacaagaacaaagauaauccaaaaaaggaaucaguguuugaguaugauuuaaucaaagauaaaagauuuacugaagauaaauucuucuuccacugcccgauuacuauuaacuucaaaagcucuggagcaaacaaauucaacgaugaaauaaaccuauuacuuaaggagaaagccaacgauguucauauacuaagcauagaucgaggagaacgacaucuagccuacuacacgcucguagacggaaaagguaauaucauaaaacaagacacauuuaacauaauuggaaaugaucgaaugaaaacaaacuaucacgacaaacuagcagcuauagaaaaagaccgcgauucggcacgaaaagauuggaaaaaaaucaauaacauuaaagaaaugaaagaagguuaucuaucacagguaguucaugaaauagcuaaauuaguaauagaauauaaugcaauagucguauuugaagauuuaaacuucgguuucaaacgcggucgcuucaaaguagaaaaacaaguauaucaaaaauuagaaaaaaugcuaauagaaaagcuaaacuauuuaguuuuuaaggauaaugaauuugauaaaacaggaggaguauuacgcgccuaucaacuaaccgcaccguucgaaacuuucaagaaaaugggaaaacagaccggcauaaucuauuauguaccagcaggauuuacaucaaaaauauguccagucaccggauuuguaaaccaacuauacccaaaauacgaaaguguaucaaaaucucaggaauuuuucagcaaauucgauaaaauaugcuacaaccuagauaagggauauuucgaauucucuuuugauuacaagaauuuuggcgauaaagcagcaaaaggaaaauggacaauugcgucguucggaagcagauuaauaaacuuucguaacagcgauaaaaaccacaacugggacacccgagaaguauaccccacgaaggaacuagaaaaauuauuaaaagauuacucaaucgaauacggacauggagaaugcauaaaagcagccauuugcggagaaucugauaaaaaauucuucgcgaaauuaacaucaguacuaaauaccauauuacagaugcgaaacaguaaaaccggcaccgaacuagauuaccuaauaucacccguagccgacguaaacgggaacuuuuucgacucacgccaagcaccaaaaaauaugccucaagaugccgaugcaaauggagcauaccacaucggacuaaaaggcuuaaugcuauuaggacggaucaaaaauaaucaagaaggaaaaaaacuaaaucuuguaauaaaaaacgaagaauauuucgaauucguccaaaaucgaaauaacaaacggccggcugcaacuaaaaaagccggacaagcuaaaaaaaaaaaaugauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 10394 - RNA, 4204 nt, Artificial Sequence
  Cpf1 variant mRNA product
ggggcgcugccuacggagguggcagccaucuccuucucggcaucaagcuuaccaugagcaagcuggagaaguuuacaaacugcuacucccugucuaagacccugagguucaaggccaucccugugggcaagacccaggagaacaucgacaauaagcggcugcugguggaggacgagaagagagccgaggauuauaagggcgugaagaagcugcuggaucgcuacuaucugucuuuuaucaacgacgugcugcacagcaucaagcugaagaaucugaacaauuacaucagccuguuccggaagaaaaccagaaccgagaaggagaauaaggagcuggagaaccuggagaucaaucugcggaaggagaucgccaaggccuucaagggcaacgagggcuacaagucccuguuuaagaaggauaucaucgagacaauccugccagaguuccuggacgauaaggacgagaucgcccuggugaacagcuucaauggcuuuaccacagccuucaccggcuucuuugauaacagagagaauauguuuuccgaggaggccaagagcacauccaucgccuucagguguaucaacgagaaucugacccgcuacaucucuaauauggacaucuucgagaagguggacgccaucuuugauaagcacgaggugcaggagaucaaggagaagauccugaacagcgacuaugauguggaggauuucuuugagggcgaguucuuuaacuuugugcugacacaggagggcaucgacguguauaacgccaucaucggcggcuucgugaccgagagcggcgagaagaucaagggccugaacgaguacaucaaccuguauaaucagaaaaccaagcagaagcugccuaaguuuaagccacuguauaaacaggugcugagcgaucgggagucucugagcuucuacggcgagggcuauacauccgaugaggaggugcuggagguguuuagaaacacccugaacaagaacagcgagaucuucagcuccaucaagaagcuggagaagcuguucaagaauuuugacgaguacucuagcgccggcaucuuugugaagaacggccccgccaucagcacaaucuccaaggauaucuucggcgaguggaacgugauccgggacaaguggaaugccgaguaugacgauauccaccugaagaagaaggccguggugaccgagaaguacgaggacgaucggagaaaguccuucaagaagaucggcuccuuuucucuggagcagcugcaggaguacgccgacgccgaucugucugugguggagaagcugaaggagaucaucauccagaagguggaugagaucuacaagguguauggcuccucugagaagcuguucgacgccgauuuugugcuggagaagagccugaagaagaacgacgccgugguggccaucaugaaggaccugcuggauucugugaagagcuucgagaauuacaucaaggccuucuuuggcgagggcaaggagacaaacagggacgaguccuucuauggcgauuuugugcuggccuacgacauccugcugaagguggaccacaucuacgaugccauccgcaauuaugugacccagaagcccuacucuaaggauaaguucaagcuguauuuucagaacccucaguucaugggcggcugggacaaggauaaggagacagacuaucgggccaccauccugagauacggcuccaaguacuaucuggccaucauggauaagaaguacgccaagugccugcagaagaucgacaaggacgaugugaacggcaauuacgagaagaucaacuauaagcugcugcccggcccuaauaagaugcugccaaagguguucuuuucuaagaaguggauggccuacuauaaccccagcgaggacauccagaagaucuacaagaauggcacauucaagaagggcgauauguuuaaccugaaugacugucacaagcugaucgacuucuuuaaggauagcaucucccgguauccaaagugguccaaugccuacgauuucaacuuuucugagacagagaaguauaaggacaucgccggcuuuuacagagagguggaggagcagggcuauaaggugagcuucgagucugccagcaagaaggagguggauaagcugguggaggagggcaagcuguauauguuccagaucuauaacaaggacuuuuccgauaagucucacggcacacccaaucugcacaccauguacuucaagcugcuguuugacgagaacaaucacggacagaucaggcugagcggaggagcagagcuguucaugaggcgcgccucccugaagaaggaggagcugguggugcacccagccaacuccccuaucgccaacaagaauccagauaaucccaagaaaaccacaacccuguccuacgacguguauaaggauaagagguuuucugaggaccaguacgagcugcacaucccaaucgccaucaauaagugccccaagaacaucuucaagaucaauacagaggugcgcgugcugcugaagcacgacgauaaccccuaugugaucggcaucgauaggggcgagcgcaaucugcuguauaucguggugguggacggcaagggcaacaucguggagcaguauucccugaacgagaucaucaacaacuucaacggcaucaggaucaagacagauuaccacucucugcuggacaagaaggagaaggagagguucgaggcccgccagaacuggaccuccaucgagaauaucaaggagcugaaggccggcuauaucucucagguggugcacaagaucugcgagcugguggagaaguacgaugccgugaucgcccuggaggaccugaacucuggcuuuaagaauagccgcgugaagguggagaaacagguguaucagaaguucgagaagaugcugaucgauaagcugaacuacaugguggacaagaagucuaauccuugugcaacaggcggcgcccugaagggcuaucagaucaccaauaaguucgagagcuuuaaguccaugucuacccagaacggcuucaucuuuuacaucccugccuggcugacauccaagaucgauccaucuaccggcuuugugaaccugcugaaaaccaaguauaccagcaucgccgauuccaagaaguucaucagcuccuuugacaggaucauguacgugcccgaggaggaucuguucgaguuugcccuggacuauaagaacuucucucgcacagacgccgauuacaucaagaaguggaagcuguacuccuacggcaaccggaucagaaucuuccggaauccuaagaagaacaacguguucgacugggaggaggugugccugaccagcgccuauaaggagcuguucaacaaguacggcaucaauuaucagcagggcgauaucagagcccugcugugcgagcaguccgacaaggccuucuacucuagcuuuauggcccugaugagccugaugcugcagaugcggaacagcaucacaggccgcaccgacguggauuuucugaucagcccugugaagaacuccgacggcaucuucuacgauagccggaacuaugaggcccaggagaaugccauccugccaaagaacgccgacgccaauggcgccuauaacaucgccagaaaggugcugugggccaucggccaguucaagaaggccgaggacgagaagcuggauaaggugaagaucgccaucucuaacaaggaguggcuggaguacgcccagaccagcgugaagcacaaaaggccggcggccacgaaaaaggccggccaggcaaaaaagaaaaagggauccuacccauacgauguuccagauuacgcuuaucccuacgacgugccugauuaugcauacccauaugauguccccgacuaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10395 - RNA, 3786 nt, Artificial Sequence
  Cpf1 variant
auggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaaguga

SEQ ID NO: 10396 - RNA, 3786 nt, Artificial Sequence
  Cpf1 variant
auggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaaguga

SEQ ID NO: 10397 - RNA, 3786 nt, Artificial Sequence
  Cpf1 variant
auggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaaguga

SEQ ID NO: 10398 - RNA, 3786 nt, Artificial Sequence
  Cpf1 variant
auggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaauga

SEQ ID NO: 10399 - RNA, 3786 nt, Artificial Sequence
  Cpf1 variant
auggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaaguga

SEQ ID NO: 10400 - RNA, 3786 nt, Artificial Sequence
  Cpf1 variant
auggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaaguga

SEQ ID NO: 10401 - RNA, 3786 nt, Artificial Sequence
  Cpf1 variant
auggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaauga

SEQ ID NO: 10402 - RNA, 4302 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10403 - RNA, 4302 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10404 - RNA, 4302 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10405 - RNA, 4302 nt, Artificial Sequence
  Cpf1 variant mRNA product
gggagagucccgcagucggcguccagcggcucugcuuguucgugugugugucguugcaggccuuauucaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10406 - RNA, 4302 nt, Artificial Sequence
  Cpf1 variant mRNA product
gggagagucccgcagucggcguccagcggcucugcuuguucgugugugugucguugcaggccuuauucaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10407 - RNA, 4302 nt, Artificial Sequence
  Cpf1 variant mRNA product
gggagagucccgcagucggcguccagcggcucugcuuguucgugugugugucguugcaggccuuauucaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10408 - RNA, 4302 nt, Artificial Sequence
  Cpf1 variant mRNA product
gggagagucccgcagucggcguccagcggcucugcuuguucgugugugugucguugcaggccuuauucaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10409 - RNA, 4399 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10410 - RNA, 4399 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10411 - RNA, 4399 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10412 - RNA, 4399 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10413 - RNA, 4399 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10414 - RNA, 4399 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10415 - RNA, 4399 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 10416 - RNA, 4083 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10417 - RNA, 4083 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10418 - RNA, 4083 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10419 - RNA, 4083 nt, Artificial Sequence
  Cpf1 variant mRNA product
gggagagcggcucggccauuuugucccagucaguccggaggcugcggcugcagaaguaccgccugcggaguaacugcaaagaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10420 - RNA, 4083 nt, Artificial Sequence
  Cpf1 variant mRNA product
gggagagcggcucggccauuuugucccagucaguccggaggcugcggcugcagaaguaccgccugcggaguaacugcaaagaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10421 - RNA, 4083 nt, Artificial Sequence
  Cpf1 variant mRNA product
gggagagcggcucggccauuuugucccagucaguccggaggcugcggcugcagaaguaccgccugcggaguaacugcaaagaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10422 - RNA, 4083 nt, Artificial Sequence
  Cpf1 variant mRNA product
gggagagcggcucggccauuuugucccagucaguccggaggcugcggcugcagaaguaccgccugcggaguaacugcaaagaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 10423 - RNA, 4025 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10424 - RNA, 4025 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10425 - RNA, 4025 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10426 - RNA, 4025 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10427 - RNA, 4025 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10428 - RNA, 4025 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10429 - RNA, 4025 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10430 - RNA, 4006 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10431 - RNA, 4006 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10432 - RNA, 4006 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10433 - RNA, 4006 nt, Artificial Sequence
  Cpf1 variant mRNA product
gggagagucccgcagucggcguccagcggcucugcuuguucgugugugugucguugcaggccuuauucaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10434 - RNA, 4006 nt, Artificial Sequence
  Cpf1 variant mRNA product
gggagagucccgcagucggcguccagcggcucugcuuguucgugugugugucguugcaggccuuauucaagcuuaccauggcgccgaaaaagaaaaggaaagugggaauacacggggugccggcggcggcagcaagcaaguuggaaaaguucaccaacuguuacucccucuccaaaaccuuaagauucaaggcgauaccugucggaaaaacccaagaaaacaucgacaauaaacgccuauuagucgaggacgaaaaacgcgccgaagauuacaaagggguaaagaaacugcucgaccgauacuaucuaucguucaucaacgauguccuacacagcaucaagcucaagaacuugaacaacuacauaagucuguucaggaaaaagacacgaaccgagaaagaaaacaaggagcuggagaaccucgagaucaaccuacgaaaggaaaucgccaaggcauuuaaaggagccgccggcuauaagagccuauucaagaaagacaucauagaaacgauccuccccgaggccgcagacgacaaggacgaaauugcucucguaaacuccuucaacggguuuacaaccgcguucacaggguucuuugacaaccgugagaacauguucagcgaggaggcuaaaagcaccucaauagccuuccgcugcaucaacgaaaaccucacucgauacaucaguaacauggacaucuucgaaaaaguugacgcaauauucgauaagcaugaaguccaggaaauaaaagaaaagauucucaacuccgacuacgacguggaggacuuuuucgaaggggaguucuucaacuucguccucacacaagaaggcauagauguguacaacgccaucaucggagguuuugugaccgaaucuggcgaaaagauaaaaggacugaacgaguacauuaaccuuuacaaugccaaaacuaaacaagccuuacccaaguucaagccccucuacaaacaagugcuguccgaccgagaaagccuaucauucuacggcgaaggauacaccucugacgaggagguacuagaagucuucagaaauacgcugaacaaaaacuccgaaauauucagcagcaucaaaaagcuagaaaaacuuuucaaaaacuuugaugaauauucaagcgccggcauauucgugaaaaauggccccgcgaucucaaccauauccaaagacauauucggagaauggaaccuaauacgcgauaaguggaacgcggaauacgaugacauccaccuaaagaagaaagccgucguaaccgaaaaauacgaggacgacagaaggaaaucguucaagaaaauuggcucguucucccuagaacagcuccaagaauacgcagacgcagaccucucagucguagaaaaacucaaggagauaauaauucagaagguagacgaaaucuacaaaguguacggaagcucagaaaagcuauucgaugcggacuucguacuggagaagagucucaagaaaaacgacgccgucguagccaucaugaaagaccuccucgacucugucaaaucguucgagaacuacauaaaggcauucuucggugaaggaaaggagaccaaccgcgacgagagcuucuacggagacuucgugcuagccuacgauauccuccucaagguugaccacaucuacgacgcaauacgaaacuacgugacccaaaaaccguauucgaaggacaaauucaaacucuacuuccaaaacccacaguucaugggcgggugggacaaggacaaggaaaccgacuaccgggccaccauacuccguuacggcuccaaauacuaccuggcaauuauggacaagaaguacgcaaaaugccuccagaaaaucgacaaagacgacgucaauggcaacuacgagaaaaucaacuacaaacugcuaccaggccccaacaagaugcucccaaaaguguucuucuccaaaaaguggauggccuauuacaacccaucagaagacauucagaaaaucuacaagaacggcacuuucaagaaaggagacauguucaaccucaacgauugccauaagcugauagauuucuucaaggacuccaucucccgauacccaaaauggagcaacgcguacgauuucaauuuuagcgaaaccgaaaaauacaaggacaucgcaggguucuaccgagaaguagaggaacaagguuacaaagucucguucgaaagcgcguccaaaaaggaaguagacaagcucguagaagaaggcaagcucuacauguuccaaauauacaauaaagacuucucggacaaaucccacggcacuccaaaccuccacaccauguacuucaaacuacuauucgaugagaacaaucacggacaaaucagacucuccggcggggcagaacuguucaugcgccgcgcaucgcuuaaaaaggaggagcucguagugcaccccgcuaacuccccgaucgccaauaaaaauccagacaaccccaagaagacaacaacccuaagcuacgacguauacaaagacaagagguucagcgaggaccaauacgaacuacacauuccaauagccaucaacaaauguccuaaaaacauuuucaagauaaacacggaagugcgaguacugcucaaacaugacgacaaccccuacguaauaggaaucgaccgcggcgaaaggaaucuacucuacaucgucguaguagacgggaagggcaauauagucgaacaauacucgcuaaacgaaaucaucaacaacuucaacgggauccgaaucaaaaccgacuaccacagucugcuagacaagaaagagaaagaaagauucgaggcccggcaaaacuggacgagcaucgagaauaucaaagaacucaaagccgguuacauaagucaagucguacacaaaaucugcgagcucguagaaaaauacgacgccguaauagcccuugaagaccuaaacagcggcuuuaagaacagccgagucaaaguggaaaagcaaguauaccaaaaauucgaaaagaugcucauagacaagcucaacuacauggucgacaagaaaagcaacccgugcgccaccggaggcgcccucaaaggcuaccaaauaacgaacaaauucgagagcuucaaaagcauguccacacagaacggcuucauauuuuacauacccgcauggcugacaagcaaaauagacccaucaacaggcuucguaaaccuccuaaaaacaaaauacaccaguaucgcagacucgaagaaauuuauuagcagcuuugaccgaaucauguacguuccugaagaggaccuuuucgaguucgcccuugacuacaagaacuuuagccguaccgacgccgacuauauuaaaaaguggaaguuguacucauacgguaacagaauccgcauauucgccgcagcgaagaaaaauaacguauucgccugggaagaggucugccucacaagcgcguacaaagaacuuuucaacaaauacgggaucaacuaccagcagggagacauaagggcacugcugugugaacaaagcgacaaagcguucuacagcagcuucauggcccucaugagccucaugcugcagaugcgcaauuccauaaccggcaggaccgaugucgacuuucugaucagcccggucaaaaauuccgacggcauauucuacgacucaaggaacuaugaagcccaggaaaacgcaauucugccgaagaaugcagacgcgaacggcgcauauaacaucgcgaggaagguccucugggccauugggcaguucaagaaagcagaagacgaaaaacuggacaaggucaagaucgccaucagcaacaaagaauggcuggaauaugcacagacgucagucaagaaaaggccagcggcaacaaaaaaggccgggcaagcgaaaaaaaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10435 - RNA, 4006 nt, Artificial Sequence
  Cpf1 variant mRNA product
gggagagucccgcagucggcguccagcggcucugcuuguucgugugugugucguugcaggccuuauucaagcuuaccauggcgcccaaaaaaaaacgcaaagucggaauccacggcgugcccgcggccgccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaaaaggccggcggcaacaaaaaaggcagggcaggcgaaaaaaaaaaagugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10436 - RNA, 4006 nt, Artificial Sequence
  Cpf1 variant mRNA product
gggagagucccgcagucggcguccagcggcucugcuuguucgugugugugucguugcaggccuuauucaagcuuaccauggcaccaaaaaaaaaaagaaaaguaggaauacacggaguaccagcagcagccgcgucgaaacuagaaaaguuuacgaacuguuauucccuaaguaaaacguugagauuuaaagcaauaccaguagggaaaacacaggaaaauauagauaauaaacgucuacucguagaagacgaaaaaagagcugaagacuauaaaggaguaaaaaaacuacuagaucgauacuacuuaucauucauaaaugauguccuacauucuauaaaauuaaaaaaucuaaauaacuacauaaguuuauuuaggaaaaagacaagaaccgaaaaagaaaauaaagaauuagaaaacuuggaaauaaauuuacgaaaagaaauugcaaaagccuuuaaaggagcagcagguuacaaaucgcuauuuaaaaaggacauaauugaaacaauacuaccugaagcggcagacgauaaagacgaaauagcacuaguaaauaguuucaauggauucacaacagcauuuaccggauucuuugacaacagagaaaacauguuuucagaagaagccaaaucaaccaguauagcauucagguguauaaacgaaaaccuaacaagauacauuaguaauauggauauauucgaaaaagucgaugcaauauucgacaaacaugaaguacaagaaauaaaagaaaaaauacugaacagugacuaugacguagaagacuucuucgaaggagaguucuucaacuuuguauuaacacaagaaggaauagacguauacaacgcaauuaucgguggcuuuguaacagaaagcggugaaaaaauuaaaggacuaaaugaauacauuaaccuuuacaacgcaaaaacaaaacaagcgcugccaaaauucaagcccuuauauaaacaaguacuaagugaccgugaaagucuaucauucuacggagaaggauacacaucagaugaagaaguauuagaaguauuccgaaauacacucaacaaaaauagcgaaauauucagcucgauaaaaaaauuagaaaaauuauucaaaaacuuugacgaguacuccuccgcugggauauucguaaaaaauggcccagcaauaaguaccauaagcaaagacauauucggggaauggaaccuaauaagagacaaauggaaugcagaauaugaugauauacaucuuaaaaaaaaagcaguagucacagaaaaauaugaagaugaccgaagaaaaucuuucaagaagauagggagcuuuucacuagaacagcuucaagaauacgcagacgccgaccuaucaguaguugaaaaauuaaaagaaauaauaauucaaaaagucgaugaaauauauaaaguguauggauccagugaaaaacuauucgaugcugauuucguacuagaaaaaucgcucaaaaaaaaugacgcaguuguugcgauaaugaaagacuuacucgauucuguuaaauccuucgaaaacuacauaaaagcauucuuuggagaaggcaaagaaacuaacagagacgaauccuucuacggagacuuugucuuagccuaugauauacuacuuaaaguugaccacaucuacgacgccauuagaaacuauguuacacaaaaaccuuauucaaaagacaaauucaaacuauauuuccaaaacccucaguucaugggaggaugggacaaagacaaagaaacagacuaucgugcuaccauuuuaagauauggaaguaaguauuaccuugcuauaauggauaaaaaauaugcgaaaugcuuacaaaaaaucgacaaagacgacguaaacgggaauuacgaaaaaauaaacuacaaguuacuaccaggaccaaauaaaauguuaccaaaaguuuuuuucagcaagaaauggauggcauacuacaauccgagcgaagacauacaaaaaauauacaaaaacggcacauucaaaaaaggagacauguuuaauuuaaacgauugccacaaauuaaucgauuuuuucaaagacucaaucucaagauacccuaaauggaguaacgcauacgacuuuaacuuuuccgaaaccgaaaaauacaaagacauugcaggcuucuacagagaaguagaagaacaaggauacaaaguaucuuuugaaucugcgaguaaaaaagaaguagacaaacucguugaagaaggaaaacuauacauguuucagaucuacaauaaagauuuuagcgacaaaagccacgguacaccuaaucuccacacaauguacuucaaacuauuauucgaugaaaacaaccacgggcaaauaagacuuagcgggggagcugaacucuuuaugcgaagagcauccuuaaagaaagaggaacuaguaguacacccugcaaacucgccaauugcaaacaaaaacccggacaaccccaaaaaaacaacuaccuuauccuaugauguguacaaagacaaaagguuuucagaggaccaguacgagcuacauauaccaaucgcaauaaauaaaugcccaaaaaauauauucaaaauuaacaccgaaguaagaguacuacucaaacaugacgacaacccuuacgucauaggaauagaucgaggggaaagaaauuugcuuuauauaguagucguagauggaaaaggcaacauagucgaacaauauaguuuaaaugaaauaauaaauaacuucaacggaauaagaauaaagaccgacuaccauaguuuacuagauaagaaagaaaaggaaagauucgaagcucggcaaaauuggaccucgaucgaaaacaucaaagaacuaaaagcgggauauauaucacaaguagugcacaaaaucugcgaacuagucgaaaaauaugaugcaguaauugcacucgaagaccuaaacuccggauucaaaaauucaagaguaaaaguagaaaaacaagucuaccaaaaauucgaaaaaaugcuaaucgacaaauuaaacuacaugguugauaagaaaucuaacccaugcgcuaccggaggagcucucaaaggguaucaaauaacaaacaaauucgagaguuuuaaaaguaugaguacgcaaaauggauucauauucuacauaccugcauggcuaacgucaaaaauagauccaagcacgggcuucgucaaccuacuuaaaacaaaauauacauccauagcagauuccaaaaaauucaucucaagcuuugacagaauaauguaugucccagaagaagaucuauuugaguucgccuuagacuacaaaaauuucaguagaacagacgcugacuauauaaaaaaauggaaacucuacucauacggaaaccguauucgcauauucgcagcugcaaaaaagaauaauguauucgccugggaggaagugugccuaacaucugcauauaaggaacuauucaacaaauaugggauaaacuaucaacagggcgacauaagggccuugcuuugugagcaaagcgauaaagcauucuacucuucauucauggcacuuauguccuuaauguuacaaaugagaaauucuauaaccggacguacagacgucgacuuucuaaucucgccuguaaaaaacucagauggaauauucuacgacuccaggaauuacgaagcacaagaaaacgccauucugccaaaaaacgccgaugccaacggggcauauaacauagcaagaaaaguacugugggcaaucggacaauuuaagaaagcagaggacgaaaagcuggauaaagucaaaauagccaucagcaauaaagaauggcucgaauacgcacaaaccucagucaagaaaagaccagcagcaacaaaaaaagcaggacaagcaaaaaaaaaaaaaugauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 10437 - RNA, 4116 nt, Artificial Sequence
  Cpf1 variant mRNA product
gggagaggcgcugccuacggagguggcagccaucuccuucucggcaucaagcuuaccauggcccccaagaagaagcgcaaggugggcauccacggggucccggccgcggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaagaagcgccccgccgccaccaagaaggcgggccaggccaagaagaagaagugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10438 - RNA, 4116 nt, Artificial Sequence
  Cpf1 variant mRNA product
gggagaggcgcugccuacggagguggcagccaucuccuucucggcaucaagcuuaccauggcccccaagaaaaagagaaaagugggcauccacggggucccugcugcagccgcuagcaagcuggagaaauucaccaacugcuacucccucucuaagacacuuagauuuaaagcaauccccgugggcaagacucaggaaaauauugacaacaaaaggcuguuggucgaggaugaaaagcgggccgaggacuauaaggggguuaaaaaguuacuggaucgcuacuaucuaucauucauaaaugacgugcuccacaguaucaaacugaagaaccuuaauaacuacauuagccuguuuaggaaaaagacgcguaccgaaaaggagaauaaagaguuggaaaaccucgagaucaaucugagaaaggaaauugcgaaggcuuucaagggagccgcagguuauaaaucccuguuuaagaaagauaucauagagacaauccucccugaggccgcugacgauaaggacgaaauugcauuaguaaacucuuucaauggcuuuacuaccgccuucacaggguuuuucgauaacagggagaauauguuuucggaagaggcuaagucaaccagcaucgccuuccgguguauuaacgaaaaucugacucgcuacaucaguaacauggacauauuugagaaaguggaugcgauuuucgacaagcaugagguccaagaaaucaaagagaagauucuuaacuccgauuaugacguggaagacuucuuugagggagaguucuuuaauuucguuuugacacaggaaggcaucgauguguacaacgcaaucauugguggguuugucaccgagucuggagaaaagauaaagggccugaaugaguacaucaaccuauauaaugccaagacgaaacaggcucucccaaaguucaaaccgcuguacaaacaggugcuuagcgacagagaaucccugucauuuuauggcgagggguacacuucugaugaagagguauuggagguuuucaggaacacccucaauaaaaacagcgaaauuuuuaguuccaucaagaagcuggagaaauuauucaagaauuuugacgaauauucaagcgccggaauauucgugaaaaacggucccgcaauuaguacaaucucuaaggauaucuuuggcgaguggaaucugauucgggacaaauggaacgcugaguacgaugacauccaccucaagaagaaagccgucgugacugaaaaguaugaggaugaccgccgaaaauccuucaagaaaauugggagcuucucgcuugaacaacugcaggaguacgcggaugccgacuugucuguggucgaaaagcuaaaagagauaaucauucagaagguugacgagaucuacaagguguauggauccucagaaaaacuguuugaugcagacuucguacucgagaagagucugaaaaagaaugaugcuguggucgccaucaugaaagaccuucuggauagcgugaaguccuuugaaaacuacauuaaggcuuucuuuggcgaggguaaagaaaccaauagagacgagucuuucuauggggauuuuguuuuggccuacgacauacuccugaagguggaucauaucuaugacgcaauuaggaacuacgucacacagaaaccuuauagcaaggauaaauucaaguuauacuuucaaaacccacaguucaugggaggcugggacaaggauaaagagaccgacuaccgggccacgauccugcguuauggcucaaaguacuaucuagcuauuauggacaaaaaguacgcgaaaugccuccagaagaucgauaaggacgaugugaaugggaacuaugaaaagauaaauuacaagcugcuucccggaccuaacaaaauguugccaaagguauuuuucaguaaaaaguggauggcauauuacaaucccuccgaggacauccagaaaauuuacaagaacgguacuuuuaagaaaggcgauauguucaaucugaacgacugucacaagcucaucgauuucuuuaaagacagcauuucucgcuauccuaaguggucaaaugccuacgauuucaacuuuagugaaacagagaaauauaaggacaucgcuggguucuacagagaaguugaggagcaaggauauaaggugagcuuugaauccgccucuaaaaaggaggucgauaaacugguggaagagggcaaacuuuacauguuccagauauauaauaaagacuuuucggauaagagccaugguaccccaaaccugcacacuauguacuucaaguugcucuuugacgagaauaaccacgggcagauuaggcuguccggcggagcagaauuauucaugcggcgagccucacugaaaaaggaggagcuagucgugcauccggcuaauagucccaucgccaacaaaaacccugacaauccaaagaaaacaaccacgcucucuuacgauguuuauaaggacaagcgcuuuagcgaagaucaauacgaacugcacauucccaucgcaauaaacaaaugcccuaagaauaucuucaaaauuaacaccgaggugagaguacuuuugaagcaugacgauaauccauaugucaucggcauugaccgaggggagcggaaccugcucuacaucgugguuguggauggaaaagguaauauagucgaacaguauucccugaacgagauuaucaauaacuucaauggcauccgcauuaagacagacuaccacucauuacuggauaagaaagaaaaggagagauuugaagcgaggcagaacuggacuagcaucgagaauauuaaagagcuuaaggcuggguauauaucucaggugguacacaaaaucugugaauugguggagaaguacgacgccguuauugcacucgaagaucugaacuccggauucaaaaauagucgugucaagguggagaagcaaguguaccagaaauuugaaaagaugcuaaucgacaaacugaacuauauggucgacaagaaaagcaaccccugcgccaccggcggugcucucaagggguaccagauuacaaauaaguucgagucuuuuaaauccaugucaacucagaacggcuucaucuuuuauauaccggccuggcugaccaguaagaucgauccuagcacaggauucguuaaucuuuugaaaaccaaguacacuucgauugcagacuccaaaaaguuuaucucuagcuucgaucggauuauguaugugcccgaggaagaccuguuugaguucgcuuuagauuacaagaacuuuucacgaacggacgccgauuauaucaaaaaguggaaacucuacaguuacggcaauagaauaaggauuuucgcggccgcuaagaaaaacaauguguucgcaugggaagagguaugucugacauccgccuauaaggagcuuuuuaacaaguacgggaucaauuaucaacagggagacauccgcgcucuguugugcgaacagucugauaaagccuucuacagcuccuuuauggcacucaugucacugaugcuacagaugcggaacagcauuaccgguagaacugacgucgauuuccugauaaguccagugaaaaauucugacggcaucuuuuaugauuccaggaacuacgaggcgcaagaaaaugccauucucccuaaaaacgcugacgccaauggggcauauaacaucgcucgcaagguucugugggccauuggacaguucaaaaaggcagaggacgaaaaacuugauaaggugaagaucgccauaagcaauaaagagugguuggaguacgcucagaccucggucaagaagagacccgccgcuaccaaaaaggcaggccaggccaaaaagaaaaagugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10439 - RNA, 4116 nt, Artificial Sequence
  Cpf1 variant mRNA product
gggagaggcgcugccuacggagguggcagccaucuccuucucggcaucaagcuuaccauggcccccaagaaaaagagaaaagugggcauccacggggucccugcugccgccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaagaagagacccgccgcuaccaaaaaggccggccaggcgaaaaagaaaaagugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 10440 - RNA, 4116 nt, Artificial Sequence
  Cpf1 variant mRNA product
gggagaggcgcugccuacggagguggcagccaucuccuucucggcaucaagcuuaccauggcaccaaaaaaaaaaagaaaaguaggaauacacggaguaccagcagcagccgcaucaaaacuagaaaaauuuacgaacugcuacagccucucaaaaacgcuuagauucaaagccauuccaguaggaaagacccaagaaaacauagacaacaaaagacuacuaguagaagaugaaaaaagagcugaagacuacaagggaguaaaaaaacuacuggauagguauuaccuaucuuucauuaacgacguucuacacucaauaaaacucaaaaaucuaaauaauuauauaagcuuauuccgaaaaaaaacaagaacagaaaaagaaaauaaagaauuggaaaauuuggaaauaaaucugagaaaagagauagcaaaggccuucaaaggagcagcaggguacaaaucccuguuuaaaaaagauauuauagaaacaauuuuaccggaagccgcagaugauaaagacgaaauagcucuagucaauucauuuaacgguuuuacaacggcauuuaccgguuucuuugacaaccgcgaaaacauguucucagaagaagcaaaaucaacgucuauagcuuuuagauguauaaaugaaaauuuaacucguuacauuaguaacauggauauauucgaaaaaguagaugcaauauucgacaaacacgagguucaggaaauuaaagaaaaaauauuaaacucagacuaugauguagaagauuucuucgaaggcgaguuuuucaacuucguacucacacaagaaggaauagacguauacaacgcaauaauagguggcuucgucacagaaagcggagaaaaaaucaaaggucuaaacgaauacaucaaucucuacaaugcaaaaacaaaacaagcucuaccuaaauuuaagccacucuauaagcaaguacuaagcgauagagaaucacuaucuuucuacggagaaggcuacacuagcgaugaagaaguacuagaaguauucaggaacacacuuaacaaaaauucggaaauauucucaagcaucaaaaagcucgaaaaacuauuuaagaacuuugaugaauauucaucagcaggaauauuuguuaaaaacggccccgccauuagcacuauaagcaaagauauauucggcgaauggaaccuuauaagagauaaauggaaugccgaauacgaugauauacaccuaaaaaaaaaggcaguuguaacugaaaaguaugaagacgacagaagaaaaaguuuuaaaaagauagguucauuuagcuuagaacaauugcaagaauacgcagacgccgaccuaucaguaguagagaagcuaaaagagauaauaauccaaaaaguagacgaaauauacaaaguauaugguucuucugaaaaacuauucgacgccgacuucgucuuagaaaaaucccuaaagaaaaacgaugccgucguagcaauaaugaaagaucuucucgauucgguaaaaagcuucgaaaacuauauaaaagcguucuuuggagaagguaaagagacuaacagagaugaauccuuuuacggcgacuucgucuuagcauaugauauccuguuaaaaguagaccacaucuacgacgcaauaagaaacuacguuacccagaaacccuauucaaaagauaaauucaaauuauauuuccagaauccacaauucaugggggggugggacaaggacaaagaaacagauuaccgagcaaccauccuaagguacggaucaaaauauuaccuggcaauaauggacaaaaaauacgcaaaaugcuuacaaaaaauagacaaagacgauguaaacggaaacuacgaaaaaauaaacuacaaacucuuacccggccccaauaaaaugcucccgaaaguauucuucagcaagaaauggauggcguacuacaaccccagcgaagacauacaaaaaauuuauaaaaacggaacauucaaaaaaggggacauguuuaaccuaaaugacugucauaaauugaucgauuuuuucaaagauagcauaagccgauauccaaaauggucaaacgcguacgauuucaacuucagugaaacugaaaaauauaaagauauagcaggauucuacagagagguugaagagcaagguuacaaaguaucguuugaaucagcaucaaaaaaagaaguggauaaguuaguagaagaaggcaaacuauacauguuucaaauauacaacaaagauuucucggacaaaagucacggaacaccaaacuuacacacaauguauuucaaacuucuuuuugaugaaaacaaucauggucaaauuagacuuucuggcggagcugaauuauuuaugcgccgggcuucucuaaaaaaagaagaacuugucgugcauccagcaaacagcccuauugcaaauaaaaaucccgacaacccaaaaaaaacuaccacacuaucauacgauguguacaaagacaaaagguucucggaagaucaauaugaacugcacauacccauagcaauuaacaaauguccaaaaaacauuuucaaaauaaauaccgaaguaagaguauuacuaaaacacgaugacaacccauacguaauaggaauagaucgaggcgaaagaaaucuacucuauauaguuguaguggacggaaaaggcaacauugucgaacaauacucacuaaacgaaauaauaaacaauuuuaauggaaucagaauuaagacagauuaccacucacuacuagauaaaaaagaaaaagaacgcuucgaagccagacaaaacuggaccuccaucgaaaauaucaaagaacuuaaagcaggauacaucagccaggugguacauaaaauaugugaacuuguugaaaaauacgacgcaguaauagccuuggaagacuuaaacagcggcuucaaaaauucgagaguaaaaguagaaaaacaaguauaccagaaauucgaaaaaauguuaauagacaaauuaaauuacaugguagacaaaaaaagcaacccuugugccacuggcggggcauuaaaaggauaccagauuacaaauaaauucgaaucuuucaaguccaugaguacgcaaaauggauucauuuucuacauacccgcguggcugacuucuaaaauagauccaaguaccggauucgucaaccuauuaaaaacaaaauacacaaguauagcagauuccaaaaaauuuauaucauccuucgacagaauaauguacgugccagaagaagacuuauucgaguucgcacuugauuacaaaaauuucucucgaacagacgccgacuauauaaaaaaauggaaauuauauucauacgguaacagaaucaggauauucgcagccgcaaagaaaaacaacguauuugcaugggaggaaguauguuuaacaucagcauauaaagaacuauuuaauaaguauggaaucaacuaccaacaaggagacauacgagccuuacucugcgaacaaucagauaaagcauuuuauaguucauucauggcacucaugucacuuauguuacaaaugcgaaacucaauaacuggaagaaccgacguagauuuccuaaucucaccaguaaaaaacucagacggaaucuucuacgauucaaggaauuaugaagcacaagaaaaugcgauauuaccaaaaaaugcagaugcaaauggagcauauaauauagcacgaaagguccucugggcaauagggcaauucaaaaaagcggaagacgaaaaauuagacaagguuaaaauagcaauauccaauaaagaauggcuagaauaugcacaaacuucagucaaaaaaagaccagcagcaacaaaaaaagcaggacaagcaaaaaaaaaaaaaugauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu
